United States Patent 12,435,323 (ENZYMES WITH RUVC DOMAINS) - sequence listing, part 4

SEQ ID NO: 11633 - protein, 618 aa, synthetic construct
AKNTLTSPVVLRAVSQTIKVVNAIIRERGCSPTFLNIELAREMAKNFMERGKIKKEQDENRLKNERLMQRIRDEYGKPSPTGLDLVKLKLFEEQGGVCAYSLKQMSLEHLFDSDYAEVDHIIPYSISFDDGYRNKVLVFSKENRDKGNRLPLEYLTGKRRDDFIVWVNANVRDYRKRQILLKEHITAEDEERFIERNLQDTKTASRFMLNYIQDHLQFSDFTSGRKKHVTAVNGSVTSYLRKRWGISKVRANGDIHHAVDALVIACTTDGMIHDVSKYAKYRESRYMADSADRFVIDPDTGEVIKEFPYPWPLFRYELEARLSHDPQNAIRGQGFPVYSEQGINVRPLFVSRMPRRKVTGPAHKETIKSGKALDCGLLVTKRPLTDLKLKDGEIQNYYMPQSDRLLYEALKTRLSLFGGDGKKAFAEPFHKPKSDGTPGPLVHKVKLCEPSTLNVSVHGGHGVADNESMVRIDVFRVEGDGYYFVPVYVADTLKPELPNRACVAHKPYNEWKEMRDEDFIFSLYPNDLVKVTHKKELKLTRALKDSDLPESYSTKSEMLYYISANIASGAISFRKHDNSYVLEGIGIKTLESFEKYTVDVLGEYYPIKKETRQSFCRK

SEQ ID NO: 11634 - protein, 732 aa, synthetic construct
RKAFDRVSKGSFAMVSSSKRNAIGSVLSIYKTSENIRTKLTEAGLEAAEIDIAEEIGSFSKFGHLSVKACDMLIPFLEKGMKYSDACAAAGIDFKGHSDNERSHLLHPTQDDYADITSPVVKRAVSQTIKVINAIIRKQGCSPTYINIELAREMAKDFKERNKLKKENDENRARNERLLERIKKEYGKSNPTGLDLVKLKLYEEQQGVCAYSIKQMSLERLFEPNYAEIDHIIPYSISFDDSYKNKVLVLTEENRNKGNRLPLQYLTGQRRDNFIVWVNSSVRNYRKKQNLLKEGFTAEDEKKFIERNLQDTKTMSRFLYNYINDNLEFAESTCGRKKKVTAVNGAVTSYMRKRWGINKIREDGDLHHAVDAVVIACTTDRMIQQVSRYSAYRECHYTQTDFSSIAVDPETGEVVQEFPYPWPQFRKELEARLAKDPARVINDLKLPFYMNSGEKLPEPLFVSRMPKRKVTGAAHKDTIKSAKALDDGYAIVKRSLTDLKLNKFNEIDNYYMPQSDTLLYEALKAQLLKFDGDAKKAFAEPFHKPKSDGTPGPIVNKVKLREPTTLNVSVHGGKGVADNDSMVRIDVFNANGKYYLVPIYIADTLKDTLPSRAITAHKPYSEWPEMDEKNFVFSLYPNDLIQVSHKKGIKLTKTQKESTLPDNMESKSFFLYYVGTNISTGALSCINHDNSYGIGGLGAKTLESLEKYTVDVLGEYHKVGKEVRQPFNIKRG

SEQ ID NO: 11635 - protein, 1088 aa, synthetic construct
MHQYAIGLDIGITSVGWAALALDADENPCGILDFGSRIFTAAEQPKTGASLAAPRREARSARRRLRRHRHRNERIRNLIVSSGLLSKEELSQLFDGQLSDIYAVRVKALDTSVSRSELARIMLHLSQRRGFRSNRKGESDQEDGKLLAAVNKNKERMGKNGYRTAGEMFLKDPLFAEHKRNKGGNYIATVTRVMVEDEIRKIFSAQRNYGSEFASAELENAYLEILLSQRSFDEGPGGNSPYGGSQIERMVGLCTLEPDEPRAAKASYSFEYFSLLEKINHIRLIHGGESTPLTDGQRRTLIELAHKSDTLSYAKIRKELNIPANHTFNMIRYKTDVPPEEVEKKEKIVCMKAYHQMRRAVDRVAKGRFAMLSNEQRNEIARVLSLYKTGEKIERALTEAGIEPCDIAELETLSFSKFGHLSVKACDKLIPFLEKGMNYNDACTAAGYDFRAHSKDGRTLYLPPLGDDCYEVTSPVVRRAISQTIKIVNAIIRRYGHSPVYVNIELAREMAKDFAERSKLKKQMDDNQKQNERMMQQIREYKHGAPTGIDLVKFKLFSEQGGVCAYSQRQMSLERLFEDNYAEVDHIIPYSISFDDSYKNKVLVLTEENRNKGNRLPMQYLTGKRKDSFVVWVNACVRDYRKRRLLLKEAYTAEDEANFKERNLQDTKTMARFMYNYINDNLQFDPSFTGRKKRVTAVNGAVTAYMRKRWGISKVREDGDRHHAVDAVIIGCTTDGMIQRVSRYASWHEKHYMRTENGSILIDPNTGEIKQEFPYPWPWFRKELEARLSNDPSRAVADLKLPFYMDDDAPHVRPLFVSRMPTRKVTGAAHKDTVKSPKALDEGYTIVKRPLTSLKLDSSGEISGYYKPESDRLLYGALKKQLAEHGGTGAKAFTEPFRKPKSDGTPGPIVNKVKLLETTTLTVPVHDGCGAADNDSMVRIDVFHIEGDGYYFVPIYVADTLRPELPSKAVVAAKSYEEWKDVKDEDFIFSLYPNDLVKVKHRRGMKLSKVFPESTLPPILECKESMFYYISSSIANGTVRFITNDNTYIIQSLGLKTLESIEKYTVDVLGEYHPVRKEKRQRFDITKG

SEQ ID NO: 11636 - protein, 1091 aa, synthetic construct
MLQYAIGLDIGITSVGWATVALDENDKPYGIINLGSRIFDAAEQPKTGESLAAPRREARSMRRRLRRHRHRNERIRELLQREKIITEEELSHLFDGQLSDIYALRVKALDEIVTNKELARILIHISQRRGFKSNRKNASTKEDGELLSAVHENESRMIQHGYRTVAELYLNDEAYKEHRRNKGGKYISTVSRDMIEDEVRKIFAAQRSLGNEATSDSFEQEFLEILLSQRSFDEGPGNGSPYAGDQIGRMIGVCTLEKNPPEPRAAKATYSFEYFSLLEAINHIRIIRKGEGNPLTPEQRRTVIDLAHKTADLNYAKIRKELGLSDEQTFNMVSYKKAEDIASAEKKAKLSHLKAYHQMRTAFERVAKGHFATITKEQRNVIGETLSRYKTSDKIRPILKEAGLSETDIDIAETLNFSKYGHLSIKACEKIIPFLEQGMKYNEACEAAGYQFKGHDGEEKQHLLSALDEDAKNTLTSPVVLRAVSQSIKVINAIIRERGCSPTFINIELAREMAKDFAERNRIKKEQEENRANNDRLMDRIRHEYGKLSPTGLDLVKLRLFEEQGGVCAYSQKQMSLEHLFDPNYAEVDHIIPYSISFDDSRKNKVLVFAKENRDKGNRLPLQYLQGKRRDDFIVWVNSCVRDYRKRQCLLKERITEEDEQRFKERNLQDTKTAASFLMNYIADHLEFAPFSSGRKKHVTAVNGSVTSYLRKRWGITKVRANGDLHHAVDALVIACTTDGMIQEVTRYSKYRESRYMPSEDGRYLVDQFTGEVVKEFPYPWPWFHQELEARLSSDPQRAVRDRNYPLYVTGEVVPRPLFVSRMPRRKVTGAAHKETIKSGKALENGLLIVKRPLTDLKLDKNDEIADYYMPQSDRLLYEALRKRLIAFNGDGKKAFAEPFHKPKHDGTPGPVVNKVKLCEKSTLNVPVLEGKGIADNDSMVRIDVFYIEGDGYYFVPIYVADTLKPELPNKACIAYRPYEEWKEMKREDFIFSLYPNDLIKVTHRKTLKLTKAQKESDLPDSYETDSELLYYIGANISTGAITCRNQDNSYLLSGIGIKTLKAIEKYTVDILGEYHPVKHEKRQTFERKKD

SEQ ID NO: 11637 - protein, 1089 aa, synthetic construct
MFPYAIGLDIGITSVGWAVVALDHQENPCAILDMGARIFDAAEHPKTGASLAAPRREARSARRRLRRHQHRNWRIRQLLIAQKVLSEEELDSLFSGVLEDIYALRVRALDGAVTRQEFARILLHLSQRRGFRSNRRTADPKEDGKILEAVKANTQRMEAGGYRTVGEMFFKDAAFQAQKRNKGGEYLTTISRDQVADEVRSLFAAQRSFGSAFASEELEEAYLSILLSQRSFDEGPGGDSPYGGNQIERMIGKCTFFPEEPRAARATYSFEYFSLLQKVNHIRLLKDGESIRLTDAQRRTILDLAHKSPDVTFAKIRKALELPPEYLFNDVRYDAQTDPDAAEKKEKLNYLKCYHMTRTAVDRNGKGRFALLSVDQRDAVGTALTLYKASDRVRQQLEAAGLEACDVDALDALGGFSKMGHISVKVCRLLIPYLEQGMNYNEACAAAGLNFRGHDGEERSRLLHITESDLEDVTSPVVRRAISQTVKVLNAIIRRYGGSPTFLNIELAREMAKDFSERKALEKEMKANRAKNERAMERIRTEFKKQNATGLDLVKLKLYEEQGGVCPYSQKQMSMQRLFEPNYAEVDHIIPYSISFDDSYRNKVLVLAEENRNKGNRLPLQYLTGKRRDDFIVWVNASVRDYRKRQKLLKTHMTEEDEKQFRERNLQDTKTMSRFLMNFIRDHLQFAESSTGRKKRVTAVNGAVTAYMRKRWGITKIREDGDLHHAVDALVIACTTDAMIQQVTRYAQLRECRYMQTDSGSFAVDESTGEVLRQFPYPWPQFRRELEARLSNDPAKVLNDLKLPFYRESGLPLPGPLFVSRMPRRKITGAAHKDTVKSPKALEEGVVIVKRPLTALKLKNGEIENYYMPGSDRLLYEALKTRLEAFGGDGAKAFAEPFYKPKHDGTPGPLVKKVKLCEPTTLNVPLHGGTGVADNDSMVRIDVFRVEGDGYYFVPIYVADTLKPELPNLACVAHKPYKDWKPMREEDFAFSLYPNDLIQVTHKSVLKLTNANKDSTLPQSIEDKTFMLYYTKANIAGGNIACQTHDSTYCVESLGIKTLEDLAKYTVDVLGKYHRIEREPRMPFHQKRS

SEQ ID NO: 11638 - protein, 1089 aa, synthetic construct
MRPYAIGLDVGITSVGWATLALDEKETPCGIIGMGSRIFDAAEQPKTGESLAAPRREARSSRRRLRRHRHRNERIRALIVRQGVISAEELTSLFDGALDDIYELRVKALDCKITDEELARILIHISQRRGFKSNRKKASTKEDGAILEAVNENKKRMQEKGYRTVAELLLRDDAFLEHKRNKGGNYITTVTRDMVADEVKAIFEAQRKFGNATAATALEDEYLEILLGQRSFDEGPGGNSPYGGSQIERMIGKCTFFPEEPRAAKATYSFEYFTLLEKINHLRLIANGSSEELTSEQRNAIIRLAHETADLNYGKIRKAIGMQPEQRFNMIRYSADKSVEEIEKKEKFNFLKAYHEMRKAFDRVSKGSFAMVSSSKRNAIGSVLSIYKTSENIRTKLTEAGLEAAEIDIAEEIGSFSKFGHLSVKACDMLIPFLEKGMKYSDACAAAGIDFKGHSDNERSHLLHPTQDDYADITSPVVKRAVSQTIKVINAIIRKQGCSPTYINIELAREMAKDFKERNKLKKENDENRARNERLLERIKKEYGKSNPTGLDLVKLKLYEEQQGVCAYSIKQMSLERLFEPNYAEIDHIIPYSISFDDSYKNKVLVLTEENRNKGNRLPLQYLTGQRRDNFIVWVNSSVRNYRKKQNLLKEGFTAEDEKKFIERNLQDTKTMSRFLYNYINDNLEFAESTCGRKKKVTAVNGAVTSYMRKRWGINKIREDGDLHHAVDAVVIACTTDRMIQQVSRYSAYRECHYTQTDFSSIAVDPETGEVVQEFPYPWPQFRKELEARLAKDPARVINDLKLPFYMNSGEKLPEPLFVSRMPKRKVTGAAHKDTIKSAKALDDGYAIVKRSLTDLKLNKFNEIDNYYMPQSDTLLYEALKAQLLKFDGDAKKAFAEPFHKPKSDGTPGPIVNKVKLREPTTLNVSVHGGKGVADNDSMVRIDVFNANGKYYLVPIYIADTLKDTLPNRAITAHKPYSEWPEMDEKNFVFSLYPNDLIKVSHKKGIKLTKTQKESTLPDNMESKSFFLYYVGTNISTGALSCINHDNSYGIGGLGAKTLESLEKYTVDVLGEYHKVGKEVRQPFNIKRG

SEQ ID NO: 11639 - protein, 1089 aa, synthetic construct
MRPYAIGLDVGITSVGWATLALDEKETPCGIIGMGSRIFDAAEQPKTGESLAAPRREARSSRRRLRRHRHRNERIRALIVRQGVISAEELTSLFDGALDDIYELRVKALDCKITDEELARILIHISQRRGFKSNRKKASTKEDGAILEAVNENKKRMQEKGYRTVAELLLRDDAFLEHKRNKGGNYITTVTRDMVADEVKAIFEAQRKFGNATAATALEDEYLEILLGQRSFDEGPGGNSPYGGSQIERMIGKCTFFPEEPRAAKATYSFEYFTLLEKINHLRLIANGSSEELTSEQRNAIIRLAHETADLNYGKIRKAIGMQPEQRFNMIRYSADKSVEEIEKKEKFNFLKAYHEMRKAFDRVSKGSFAMVSSSKRNAIGSVLSIYKTSENIRTKLTEAGLEAAEIDIAEEIGSFSKFGHLSVKACDMLIPFLEKGMKYSDACAAAGIDFKGHSDNERSHLLHPTQDDYADITSPVVKRAVSQTIKVINAIIRKQGYSPTYINIELAREMAKDFKERNKLKKENDENRARNERLLERIKKEYGKSNPTGLDLVKLKLYEEQQGVCAYSIKQMSLERLFEPNYAEIDHIIPYSISFDDSYKNKVLVLTEENRNKGNRLPLQYLTGQRRDNFIVWVNSSVRNYRKKQNLLKEGFTAEDEKKFIERNLQDTKTMSRFLYNYINDNLEFAESTCGRKKKVTAVNGAVTSYMRKRWGINKIREDGDLHHAVDAVVIACTTDRMIQQVSRYSAYRECHYTQTDFSSIAVDPETGEVVQEFPYPWPQFRKELEARLAKDPARVINDLKLPFYMNSGEKLPEPLFVSRMPKRKVTGAAHKDTIKSAKALDDGYAIVKRSLTDLKLNKFNEIDNYYMPQSDTLLYEALKAQLLKFDGDAKKAFAEPFHKPKSDGTPGPIVNKVKLREPTTLNVSVHGGKGVADNDSMVRIDVFNANGKYYLVPIYIADTLKDTLPSRAITAHKPYSEWPEMDEKNFVFSLYPNDLIKVSHKKGIKLTKTQKESTLPDNMESKSFFLYYVGTNISTGALSCINHDNSYGIGGLGAKTLESLEKYTVDVLGEYHKVGKEVRQPFNIKRG

SEQ ID NO: 11640 - protein, 1089 aa, synthetic construct
MRPYAIGLDVGITSVGWATLALDEKETPCGIIGMGSRIFDAAEQPKTGESLAAPRREARSSRRRLRRHRHRNERIRALIVRQGVISAEELTSLFDGALDDIYELRVKALDCKITDEELARILIHISQRRGFKSNRKKASTKEDGAILEAVNENKKRMQEKGYRTVAELLLRDDAFLEHKRNKGGNYITTVTRDMVADEVKAIFEAQRKFGNATAATALEDEYLEILLGQRSFDEGPGGNSPYGGSQIERMIGKCTFFPEEPRAAKATYSFEYFTLLEKINHLRLIANGSSEELTSEQRNAIIRLAHETADLNYGKIRKAIGMQPEQRFNMIRYSADKSVEEIEKKEKFNFLKAYHEMRKAFDRVSKGSFAMVSSSKRNAIGSVLSIYKTSENIRTKLTEAGLEAAEIDIAEEIGSFSKFGHLSVKACDMLIPFLEKGMKYSDACAAAGIDFKGHSDNERSHLLHPTQDDYADITSPVVKRAVSQTIKVINAIIRKQGCSPTYINIELAREMAKDFKERNKLKKENDENRARNERLLERIKKEYGKSNPTGLDLVKLKLYEEQQGVCAYSIKQMSLERLFEPNYAEIDHIIPYSISFDDSYKNKVLVLTEENRNKGNRLPLQYLTGQRRDNFIVWVNSSVRNYRKKQNLLKEGFTAEDEKKFIERNLQDTKTMSRFLYNYINDNLEFAESTCGRKKKVTAVNGAVTSYMRKRWGINKIREEGDLHHAVDAVVIACTTDRMIQQVSRYSAYRECHYTQTDFSSIAVDPETGEVVQEFPYPWPQFRKELEARLAKDPARVINDLKLPFYMNSGEKLPEPLFVSRMPKRKVTGAAHKDTIKSAKALDDGYAIVKRSLTDLKLNKFNEIDNYYMPQSDTLLYEALKAQLLKFDGDAKKAFAEPFHKPKSDGTPGPIVNKVKLREPTTLNVSVHGGKGVADNDSMVRIDVFNANGKYYLVPIYIADTLKDTLPSRAITAHKPYSEWPEMDEKNFVFSLYPNDLIKVSHKKGIKLTKTQKESTLPDNMESKSFFLYYVGTNISTGALSCINHDNSYGIGGLGAKTLESLEKYTVDVLGEYHKVGKEVRQPFNIKRG

SEQ ID NO: 11641 - protein, 1089 aa, synthetic construct
MRPYAIGLDVGITSVGWATLALDEKETPCGIIGMGSRIFDAAEQPKTGESLAAPRREARSSRRRLRRHRHRNERIRALIVRQGVISAEELTSLFDGALDDIYELRVKALDCKITDEELARILIHISQRRGFKSNRKKASTKEDGAILEAVNENKKRMQEKGYRTVAELLLRDDAFLEHKRNKGGNYITTVTRDMVADEVKAIFEAQRKFGNATAATTLEDEYLEILLGQRSFDEGPGGNSPYGGSQIERMIGKCTFFPEEPRAAKATYSFEYFTLLEKINHLRLIANGSSEELTSEQRNAIIRLAHETADLNYGKIRKAIGMQPEQRFNMIRYSADKSVEEIEKKEKFNFLKAYHEMRKAFDRVSKGSFAMVSSSKRNAIGSVLSIYKTSENIRTKLTEAGLEAAEIDIAEEIGSFSRFGHLSVKACDMLIPFLEKGMKYSDACAAAGIDFKGHSDNERSHLLHPTQDDYADITSPVVKRAVSQTIKVINAIIRKQGCSPTYINIELAREMAKDFKERNKLKKENDENRARNERLLERIKKEYGKSNPTGLDLVKLKLYEEQQGVCAYSIKQMSLERLFEPNYAEIDHIIPYSISFDDSYKNKVLVLTEENRNKGNRLPLQYLTGQRRDNFIVWVNSSVRNYRKKQNLLKEGFTAEDEKKFIERNLQDTKTMSRFLYNYINDNLEFAESTCGRKKKVTAVNGAVTSYMRKRWGINKIREDGDLHHAVDAVVIACTTDRMIQQVSRYSAYRECHYTQTDFSSIAVDPETGEVVQEFPYPWPQFRKELEARLAKDPARVINDLKLPFYMNSGEKLPEPLFVSRMPKRKVTGAAHKDTIKSAKALDDGYAIVKRSLTDLKLNKFNEIDNYYMPQSDTLLYEALKAQLLKFDGDAKKAFAEPFHKPKSDGTPGPIVNKVKLREPTTLNVSVHGGKGVADNDSMVRIDVFNANGKYYLVPIYIADTLKDTLPSRAITAHKPYSEWPEMDEKNFVFSLYPNDLIKVSHKKGIKLTKTQKESTLPDNMESKSFFLYYVGTNISTGALSCINHDNSYGIGGLGAKTLESLEKYTVDVLGEYHKVGKEVRQPFNIKRG

SEQ ID NO: 11642 - protein, 1089 aa, synthetic construct
MRPYAIGLDVGITSVGWATLALDEKETPCGIIGMGSRIFDAAEQPKTGESLAAPRREARSSRRRLRRHRHRNERIRALIVRQGVISAEELTSLFDGALDDIYELRVKALDCKITDEELARILIHISQRRGFKSNRKKASTKEDGAILEAVNENKKRMQEKGYRTVAELLLRDDAFLEHKRNKGGNYITTVTRDMVADEVKAIFEAQRKFGNATAATALEDEYLEILLGQRSFDEGPGGNSPYGGSQIERMIGKCTFFPEEPRAAKATYSFEYFTLLEKINHLRLIANGSSEELTSEQRNAIIRLAHETADLNYGKIRKAIGMQPEQRFNMIRYSADKSVEEIEKKEKFNFLKAYHEMRKAFDRVSKGSFAMVSSSKRNAIGSVLSIYKTSENIRTKLTEAGLEAAEIDIAEEIGSFSKFGHLSVKACDILIPFLEKGMKYSDACAAAGIDFKGHSDNERSHLLHPTQDDYADITSPVVKRAVSQTIKVINAIIRKQGCSPTYINIELAREMAKDFKERNKLKKENDENRARNERLLERIKKEYGKSNPTGLDLVKLKLYEEQQGVCAYSIKQMSLERLFEPNYAEIDHIIPYSISFDDSYKNKVLVLTEENRNKGNRLPLQYLTGQRRDNFIVWVNSSVRNYRKKQNLLKEGFTAEDEKKFIERNLQDTKTMSRFLYNYINDNLEFAESTCGRKKKVTAVNGAVTSYMRKRWGINKIREDGDLHHAVDAVVIACTTDRMIQQVSRYSAYRECHYTQTDFSSIAVDPETGEVVQEFPYPWPQFRKELEARLAKDPARVINDLKLPFYMNSGEKLPEPLFVSRMPKRKVTGAAHKDTIKSAKALDDGYAIVKRSLTDLKLNKFNEIDNYYMPQSDTLLYEALKAQLLKFDGDAKKAFAEPFHKPKSDGTPGPIVNKVKLREPTTLNVSVHGGKGVADNDSMVRIDVFNANGKYYLVPIYIADTLKDTLPSRAITAHKPYSEWPEMDEKNFVFSLYPNDLIKVSHKKGIKLTKTQKESTLPDNMESKSFFLYYVGTNISTGALSCINHDNSYGIGGLGAKTLESLEKYTVDVLGEYHKVGKEVRQPFNIKRG

SEQ ID NO: 11643 - protein, 1089 aa, synthetic construct
MRPYAIGLDVGITSVGWATLALDEKETPCGIIGMGSRIFDAAEQPKTGESLAAPRREARSSRRRLRRHRHRNERIRALIVRQGVISAEELTSLFDGALDDIYELRVKALDCKITDEELARILIHISQRRGFKSNRKKASTKEDGAILEAVNENKKRMQEKGYRTVAELLLRDDAFLEHKRNKGGNYITTVTRDMVADEVKAIFEAQRKFGNATAATALEDEYLEILLGQRSFDEGPGGNSPYGGSQIERMIGKCTFFPEEPRAAKATYSFEYFTLLEKINHLRLIANGSSEELTSEQRNAIIRLAHETADLNYGKIRKAIGMQPEQRFNMIRYSADKSVEEIEKKEKFNFLKAYHEMRKAFDRVSKGSFAMVSSSKRNAIGSVLSIYKTSENIRTKLTEAGLEAAEIDIAEEIGSFSKFGHLSVKACDMLIPFLEKGMKYSDACAAAGIDFKGHSDNERSHLLHPTQDDYADITSPVVKRAVSQTIKVINAIIRKQGCSPTYINIELAREMAKDFKERNKLKKENDENRARNERLLERIKKEYGKSNPTGLDLVKLKLYEEQQGVCAYSIKQMSLERLFEPNYAEIDHIIPYSISFDDSYKNKVLVLTEENRNKGNRLPLQYLTGQRRDNFIVWVNSSVRNYRKKQNLLKEGFTAEDEKKFIERNLQDTKTMSRFLYNYINDNLEFAESTCGRKKKVTAVNGAVTSYMRKRWGINKIREDGDLHHAVDAVVIACTTDRMIQQVSRYSAYRECHYTQTDFSSIAVDPETGEVVQEFPYPWPQFRKELEARLAKDPARVINDLKLPFYMNSGEKLPEPLFVSRMPKRKVTGAAHKDTIKSAKALDDGYAIVKRSLTDLKLNKFNEIDNYYMPQSDTLLYEALKAQLLKFDGDAKKAFAEPFHKPKSDGTPGPIVNKVKLREPTTLNVSVHGGKGVADNDSMVRIDVFNANGKYYLVPIYIADTLKDTLPSRAITAHKPYSEWPEMDEKNFVFSLYPNDLIKVSHKKGIKLTKTQKESTLPDNMESKSFFLYYVGTNISTGALSCINHDNSYGIGGLGAKTLESLEKYTVDVLGEYHKVGKEVRQPFNIKRG

SEQ ID NO: 11644 - protein, 1089 aa, synthetic construct
MRPYAIGLDVGITSVGWATLALDEKETPCGIIGMGSRIFDAAEQPKTGESLAAPRREARSSRRRLRRHRHRNERIRALIVRQGVISAEELTSLFDGALDDIYELRVKALDCKITDEELARILIHISQRRGFKSNRKKASTKEDGAILEAVNENKKRMQEKGYRTVAELLLRDDAFLEHKRNKGGNYITTVTRDMVADEVKAIFEAQRKFGNATAATTLEDEYLEILLGQRSFDEGPGGNSPYGGSQIERMIGKCTFFPEEPRAAKATYSFEYFTLLEKINHLRLIANGSSEELTSEQRNAIIRLAHETADLNYGKIRKAIGMQPEQRFNMIRYSADKSVEEIEKKEKFNFLKAYHEMRKAFDRVSKGSFAMVSSSKRNAIGSVLSIYKTSENIRTKLTEAGLEAAEIDIAEEIGSFSKFGHLSVKACDMLIPFLEKGMKYSDACAAAGIDFKGHSDNERSHLLHPTQDDYADITSPVVKRAVSQTIKVINAIIRKQGCSPTYINIELAREMAKDFKERNKLKKENDENRARNERLLERIKKEYGKSNPTGLDLVKLKLYEEQQGVCAYSIKQMSLERLFEPNYAEIDHIIPYSISFDDSYKNKVLVLTEENRNKGNRLPLQYLTGQRRDNFIVWVNSSVRNYRKKQNLLKEGFTAEDEKKFIERNLQDTKTMSRFLYNYINDNLEFAESTCGRKKKVTAVNGAVTSYMRKRWGINKIREDGDLHHAVDAVVIACTTDRMIQQVSRYSAYRECHYTQTDFSSIAVDPETGEVVQEFPYPWPQFRKELEARLAKDPARVINDLKLPFYMNSGEKLPEPLFVSRMPKRKVTGAAHKDTIKSAKALDDGYAIVKRSLTDLKLNKFNEIDNYYMPQSDTLLYEALKAQLLKFDGDAKKAFAEPFHKPKSDGTPGPIVNKVKLREPTTLNVSVHGGKGVADNDSMVRIDVFNANGKYYLVPIYIADTLKDTLPSRAITAHKPYSEWPEMDEKNFVFSLYPNDLIKVSHKKGIKLTKTQKESTLPDNMESKSFFLYYVGTNISTGALSCINHDNSYGIGGLGAKTLESLEKYTVDVLGEYHKVGKEVRQPFNIKRG

SEQ ID NO: 11645 - protein, 1089 aa, synthetic construct
MRPYAIGLDVGITSVGWATLALDEKETPCGIIGMGSRIFDAAEQPKTGESLAAPRREARSSRRRLRRHRHRNERIRALIVRQGVISAEKLTSLFDGALDDIYELRVKALDCKITDEELARILIHISQRRGFKSNRKKASTKEDGAILEAVNENKKRMQEKGYRTVAELLLRDDAFLEHKRNKGGNYITTVTRDMVADEVKAIFEAQRKFGNATAATALEDEYLEILLGQRSFDEGPGGNSPYGGSQIERMIGKCTFFPEEPRAAKATYSFEYFTLLEKINHLRLIANGSSEELTSEQRNAIIRLAHETADLNYGKIRKAIGMQPEQRFNMIRYSADKSVEEIEKKEKFNFLKAYHEMRKAFDRVSKGSFAMVSSSKRNAIGSVLSIYKTSENIRTKLTEAGLEAAEIDIAEEIGSFSKFGHLSVKACDMLIPFLEKGMKYSDACAAAGIDFKGHSDNERSHLLHPTQDDYADITSPVVKRAVSQTIKVINAIIRKQGCSPTYINIELAREMAKDFKERNKLKKENDENRARNERLLERIKKEYGKSNPTGLDLVKLKLYEEQQGVCAYSIKQMSLERLFEPNYAEIDHIIPYSISFDDSYKNKVLVLTEENRNKGNRLPLQYLTGQRRDNFIVWVNSSVRNYRKKQNLLKEGFTAEDEKKFIERNLQDTKTMSRFLYNYINDNLEFAESTCGRKKKVTAVNGAVTSYMRKRWGINKIREDGDLHHAVDAVVIACTTDRMIQQVSRYSAYRECHYTQTDFSSIAVDPETGEVVQEFPYPWPQFRKELEARLAKDPARVINDLKLPFYMNSGEKLPEPLFVSRMPKRKVTGAAHKDTIKSAKALDDGYAIVKRSLTDLKLNKFNEIDNYYMPQSDTLLYEALKAQLLKFDGDAKKAFAEPFHKPKSDGTPGPIVNKVKLREPTTLNVSVHGGKGVADNDSMVRIDVFNANGKYYLVPIYIADTLKDTLPSRAITAHKPYSEWPEMDEKNFVFSLYPNDLIKVSHKKGIKLTKTQKESTLPDNMESKSFFLYYVGTNISTGALSCINHDNSYGIGGLGAKTLESLEKYTVDVLGEYHKVGKEVRQPFNIKRG

SEQ ID NO: 11646 - protein, 1086 aa, synthetic construct
MSAYGIGLDIGITSVGWAAVALDTEEKPCGILDMGARIFDAAEQPKTGASLAAPRREARSARRRLRRHRHRNERIRQLLVREGVLSEEELAELFDGRLEDIYALRVKALDEAVDREAFARILLHLAQRRGFRSNRKSASTQEDGKILEAVAANLHRMEEAGYRTAGEMLCKDAAFAEQKRNKGGEYLTTLSRDMVADEARKIFEAQRGFRNAFASEELENCYLEILLSQRSFDEGPGGNSPYGGNQIERMIGRCTFFPEEPRAARAAYSFEYFSLLQKINHIRLIRDGESRALSEEQRKKLIELAHQSTALDFAKIRKALEIGPEYRFSAVPYRTEADADAAEKKEKFNYLKSYHAMRTAIERGGKGRFALLSVEQRDAAGTILTLYKAEGKVRDELAKAGFEACDIENLLACSFSKTGHISLKACRMLNPYLEQGMNYNEACEAAGFAFKGHVGGEKSLLLHPTEEDLADITSPVVRRAVSKTVKVLNAIIRRYGESPHFLNIELAREMAKDFSERKALEKEMRENRAKNERMMERIRGEYGVVNAGGLDLVKLKLFEEQGGVCAYSQKPISMERLFEPNYAEVDHIIPYSISFDDSYRNKVLVLTEENRNKGNRLPLQYLSGQRREDFIVWVNGSVRDYRKRQKLLKERITAEDEAQFKERNLQDTKTMSRFLMNYINDNLAFAQSSRKKRVTAVNGSVTSYLRKRWGINKNRADGDLHHAVDALVIACTTDGMIRQLSRYAVYRECRYMQGEDRSLAIDETTGEVLREFPYPWPLFRKELEARLSRDPARVIQDLKIPFYYESGRTLPGPLFVSRMPRRKISGPAHKDTVKSPRELDEGRVIVKRALTDLKLKNGEIENYYDPGSDRLLYDALRDRLAAFGGNAAKAFAEPFYKPRRDGTPGPLVKKVKLLEPSTLNVPVHEGKGVADNDTMVRIDVFQVEGDGYYFVPIYVADTLRPELPNRACVQRKPYMEWKFMREEDFCFSLYPNDLLHVVHKHGLKLSRVNAESAMPESKTVKEIMLYFISAGISTASISCRNHDNSYEIKSLGIKTLDRLEKYSVDVLGETHRVGREPRLPFTQKRS

SEQ ID NO: 11647 - protein, 1089 aa, synthetic construct
MSTYAIGLDIGIASVGWAALALDSAEKPCGILDMGSRIFDAAEQPKTGASLAAPRREARSSRRRLRRHRHRNERIRRLFLTQRLLSAEELDGLFSGVLEDIYALRARALDEPISPGDFARILLHLSQRRGFRSNRRSAADKEEGRILEAVAENLHRMEAGGYRTVGEMLCRDPAFQAHKRNKGGDYTATITRSLVEAEAKAIFTAQRGFGNSFASEVLEDAYLSILLSQRSFDEGPGGDSPYGGSQIERMVGRCTFFPDEPRAARACYSFERFNLLQKINHIRLLEAGDTRCLTAAERKALEELAHKSPDLDYARIRKELKLPDSVFFNTVRYGKDDPAAAEKKEKFNYLKAYHVMRTAIDRNGKGRFALLSVEQRDSIGTILTLYKSEERLQKELFSVGLEPCDIDSLLSIGGFSKTGHISLKACRLLLPHLEHGLNYNEACAAAGLDFRAHGGGERSLLLHPAEEDLAEITSPVVRRAVSQTVKVLNAIIRRYGESPTFINIELAREMAKDFSERKAIDREHRQNQAENERLLERIRTEYGKRNATGLDLVKLRLYEEQGGVCAYSQKQLSMERLFEPNYAEVDHIIPYSISFDDSRRNKVLVLTEENRNKGNRLPLQYLTGKRREDFIVWVNTCVRDSRKRQKLLKETFSEEEKKQFRERNLQDTKTISRFLMNFIQDNLLFAPSACGRRKRVTAVNGAVTSYMRKRWGIGKNRADGDLHHAVDALVIACTTDAMIQQISRYAEYRECRYMPTESGSLALDTATGEVLREFPYPWPMFRKELEARLSSNPAKLIQEWKIPFYLESGRPLPGPLFVSRMPRRKITGAAHKDTVKSPRILSDEGRVLVRRPLTDLKLKDGEIENYYAPDSDRLLYEALKARLTAFGGNAAKAFAEPFYKPKSDGSPGPLVRKVKLSEPATLTVPIHSGAGVADNDSMVRIDVFFIPGDGYYYVPIYVADTLKPALPNLACVAFKPQTEWREMQDKDFLFSLYPNDLIRITHKRGLKLSVTGKESSLPPVVEVKESLLYYVSANISVASISCRNHDNSYEVKSLGVKTLEQLEKYTVDVLGEAHPVGRERRLPFTQKRS

SEQ ID NO: 11648 - protein, 1093 aa, synthetic construct
MHQYAIGLDIGVTSVGWAALALDGDENPCGILDMGSRIFAAAEHPKTGASLALPRREARSARRRLRRHRHRNERIRQLFVNSGLVSEEELASLFDGKGLPDVYALRVRALDEPVTAAEMARILLHISQRRGFRSNRKGGESKEDGELLKAVGENKKRMAEHGYRTVGEMFLKDKMFASRKRNKGGKYTTTVTRGMVEDEVHAIFSAQRGFGAAFAGEDFESAYTEILLSQRSFDDGPACGPYSGSQIERMIGKCTFEPTEPRCAKGAYSFEVFTLWEKINHIRLICGGKSERLSDSQRKRIFELAHEKENINYAVIRKELGIAECFTFNMVKYPKDVSIEEAEKKEKTAFLKSYHMLRKALGKNGKNRIAFITVSQRNEIARILSTYKTSEKIRPQLEALGLEKCDIDIIEGLNYSKFGHLSVKACDKIIPFLEKGMTYNEACQAAGYDFRAHSGEEKSRLLPPIGDDCNEITSPVVRRTVSQTIKVVNAIIRRYNESPIYINIELARELSKDFSERQTIKRDMDENRKRNERVMEQIAEYKRGAPTGLDLVKMKLFEEQGGVCAYSLRQMSIERLFEPNYAEVDHIVPYSISFDDSYKNKVLVLTEENRNKGNRLPMQYLTGKRKDDFQVWVNACIRDSRKKRLLLKETFTDEDEKNFKERALQDTKTASVFMLNYINDNLIFAPSLKGRKKRVTAVNGAVTAYMRKRWGIAKIREDGDTHHAVDAVVIGCTTDGMIQKVSRYASWHECHYMRTETGSILIDPSTGEIKQEFPYPWEHFRKELEARTANDPSRAVAALKLPFYMDDDAPRVHPLFVSRMPTRKVTGAAHKDTVKSAKAKDDGYAIVKRPLTALKLDKDGEIAGYYKPESDRLLYEALKKQLIAHGGDGAKAFKEPFYKPKSSKPKCADTPPNEVCKVKLLEPITLSVDVQGKTGIADNDSMVRIDVFKVEGDGYYFVPIYVADTLKDKLPSKACVAFKPYEQWKEMSDSDFVFSLYPNDLLKVSHKRTLKLTKTFKESTLPASIECKEILMYYRGAGISTASISCFTHDNTYEIPSLGIKTLASIEKYEVDVLGEYHPVKQEARQGFGKKGG

SEQ ID NO: 11649 - protein, 1090 aa, synthetic construct
MLPYAIGLDIGITSVGWATVALDQEDQPFGIIGMGARIFDAAEQPKTGASLAAPRREARSMRRRLRRHAHRNERIRRLIVQKGLLTEEQLLHLFDGQLSDVYQLRVDALDRIVNNKELARILIHISQRRGFKSNRKGDASGEDGELLASVNANKSRMAEKGYRTVAEMLLKDEAYQEHRRNKGGKYIATVSRDMVADEVRLIFTSQRKLGSQIADETLEAEYLEILLSQRSFDDGPGANSPYAGSQIERMIGSCTFEPGEPRAARATYSFEYFSLLEAVNHIRLVRNGSGEALSAEQRETIVALAHKTADLNYARIRKELGLPAELTFNTVSYRDGTEQEQAEKKAKLGCMKAYHQMRAAFDRLSKGHFATFTKEQRNEIGYTLSVFKTSEKIRPRLEKVGLSDADMDIAETLNFSKFGHLSVKACDKLIPFLEQGMKYNEACEAAGYAFKAHEGKEKSKLLPPLDEEARNTITSPVVLRAISQSIKVVNAIVRERGCSPTFVNIELAREMSKDFYERNQIKKEQDSNRAENERRMERIRTEYGKASPTGQDLVKLRLYEEQGGISPYSQKPIRIEHLFDADYAEVDHIIPYSISFDDGYKNKVLVLAGENRDKGNRLPLEYLTGEKRDRFIVWVNNSVRDYRKRQQLLKEKITSEDEARFKERNLQDTKTASRFFLNYIDDHLAFAPFQTERKKRVTAVNGSVTSYLRKRWGISKVRANGDLHHAVDALVVACTTDGMIQAVSRYAEYRENRYLHEEGNRFVIDKTTGEIVKEFPYPWAWFRRELEARLGHDPEVAVMEQNFPVYAGGQVPVHPLFVSRMPRHKVTGAAHLQTVKSGKVFEEQGMLIVKRALADLKLDREGEIADYYRPQDDRPLYEALKERLKAFGGNAAKAFADPFYKPKSDGTPGPLVRKVKLQEKSTLAVPLHGGDGMANHDSMVRVDVFRVKDDGYYVVPIYVADTLKPELPNRAVAVQKPYSEWREMREEDFLFSLYPNDLVRVSRKKPFELKVSQPGSDLPETIQSTSELLYYVSLDINSAVAAFRSHDNSYSLPKLGLKTLDSIEKYTVDILGNYHPVKREKRLGFSGKES

SEQ ID NO: 11650 - protein, 782 aa, synthetic construct
CLKSAEVNYAKIRKELELPETQTFNMVYYGKGDPAESEKKTKFSHMKAYHQMRTAFERVSKGHFASITRSQRNVIAETLSRYKTSVKIRPLLEAAGLSSVDIDIAETLSFSKFGHLSVKACDRIIPYLEQGMKYTDACEAAGYHFKAHDTENKSLLLPALDDDAGNSITSPVALRAISQTIKVVNAIIRERGCSPTFINIELARDMSKSFQERNSIKKEQEENRENNERLMERIRKEFHVENPTGQDLVKLKLYEEQSGVCAYSIKQMSMAHLFDSDYAEVDHIIPYSISFDDSYKNKVLVFANENRDKGNRIPLQYLTGKRRDDFIVWVNSNVRNYRKRQNLLKEGITEEDEKRFIDRNLQDTKTASSFLLNYLNDNLSFAAFSNGRKKHVTAVNGSVTSYMRKRWGLTKVRANGDLHHAVDALVVVCTTDSMIHEVSKYAKYRETRYAVDASDRFIVDPETGEVIKEFPLPWPQFRWELEIRLSKNPLESMREQRLPLAERKDVRIHPLFVSRMPRRKVTGAAHQETVKGAKAVKDGCLIVKKPLSDLKLGKDGEIENYYMPQSDRLLYEALKLRLQAHDGKGKNAFSEPFRKPRRDGSPGPVVNKVKLLEPSTMSVPVHGGKGAADNESMVRIDVFYVENDGYYFVPIYVADTLKSQLPNRACVAHRTYAEWKEMRDEDFIFSLYPNVLFRATHKSKLKMTKAQKESDLAESYETKSELLYFVSAGISGASLTCRNHDNSYMISSLGIKTLEAFEKYTVDVLGNYYPVKKERRIPFGKK

SEQ ID NO: 11651 - protein, 1090 aa, synthetic construct
MLPYAIGLDIGITSVGWATVALDRDDQPFGIIGMGSRIFDAAEQPKTGASLAAPRREARSMRRRLRRHAHRNERIRRLILRSGLLTEMELAGLFEGQLPDIYQLRVNALDKLVNNKELARILIHISQRRGFKSNRKGDASGEDGELLASVNANKARMEQKGYRTVAEMLLKDEAYLEHRRNKGGKYIATVSRDMVADEVRKIFDAQRKLGSRSAGEGFEAEYLEILLSQRSFDDGPGANSPYAGSQIERMIGKCTFEEGEMRAAKASYSFEYFSLLEAVNHIRLIRSGSGEALTAQQRESILALAHKTSDLNYAKIRKELGLPAEVTFNTVSYRNGIEQEQAEKKTKLGCMKAYHQMRTAFDRLAKGHFATFTKEQRNELGYTLSVYKTSEKIRPRLREIGLTEADIDIAETLSFSKFGHLSVKACDKIIPFLEQGMKYSDACEAAGYAFKAHDGEEKSRLLPPLDEDARNTITSPVVLRSISQAIKVVNAIIRERGCSPTFVNIELAREMSKDFYERNQIKKEQDSNRAENERRMERIRTEYGKASPTGQDLVKLRLYEEQGGISPYSQKPIQIEHLFDADYAEVDHIIPYSISFDDSYKNKVLVLAGENRDKGNRLPLEYLTGEKRDRFIVWVNSSVRDYRKKQQLLKEKITPEDEARFKERNLQDTKTASRFFLNYVGDHLAFAPFQTERKKRVTAVNGSVTSYLRKRWGISKVRANGDLHHAVDALVVACTTDGMIHAVSRYAEYRENRYLHKEGSRFVVDRSTGEIVKEFPYPWAWFRRELEARLGHDPEVAVMEQNFPVYAGGEIPVRPLFVSRMPRHKVTGAAHLQTVKSGRVFEEQGVLIVKRALTELKLDKDGEIADYYRPQDDRLLYEALKERLKAFGGNAAKAFAEPFFKPKSDGSPGPLVRKVKLLEKSTLAVPLHGGEGMANHDSMVRVDVFHVKGDGFYVVPIYVADTLKAELPNRAVVGQKPYSEWKEMREEDFLFSLYPNDLVRVTRSKPFELKISQPDSDLPETVQSTSELLYYMSLDINSAVAAFRSHDNSYSLPKLGIKTLDSIEKYTVDVLGNYYPVKREKRLGFSGKGG

SEQ ID NO: 11652 - protein, 1089 aa, synthetic construct
MVPYAIGLDVGVASVGWAAVALDEKENPRGILDMGSRIFDAAEQPKTGASLAAPRREKRSTRRRLRRKRHRKERIRQLLVSTQLLSEEELSSLYEGELADVYELRVKALDCAVSNKDFARILLHLSQRRGFRSNRSSASAKEEGQLLEAVSENARRMEECGYRTVGEMLLRDPLFRDHKRNKGGNYLATVSRELIEDEVRQLFAAQRLAGNEFADAKLEEAYLAVLLSQRSFDEGPGEPSPYGGSQIEKMVGKCTFFPEEPRAAKASYSFEYFTLLQKISHIRLIRDGESQALSEAQRRSLIELAHRSSNLDFGRIRKELEIPGDTRFNVVSYRLDADADKAEKKEKFNHLQAYHAMRTAIERGGKGRFARLSPEQRDQIGTVLTLYKSEERVRQELENAGLEACDIEALFSLGGFSKTGHISIRACKMLIPYLEKGMTYNEACDAAGLSFRAHTGTEKGLLLHLSEDDLADITSPVVRRAVSQTIIVLNALIRRYEGSPVFLNIELARELSRDFSERKQMERDMRDNRAKNERAMERIRKEFGKQNATGLDLVKLKLFEEQDGVCAYSLRHIDPARLFEPNYVEVDHIVPYSLSFDDSYNNKVLVFSEENRNKGNRLPLQYLSGQRREDYIVWVNASVRSYRKRQKLLKERLTEEDEKQFKERALQDTKTAARFLLNLFQDHLQFSPSVTGKKKRVTAVNGAVTAYMRKRWGIVKIREDGDLHHAVDALVVACTTDAMIQQVSRYSALRECRYMQTEDGSLAIDEKSGEVLREFPYPWSQFRRELEARLSNDPARKIRDLRLPFYFENGLPLPKPLFVSRMPRRKISGPAHLDTVKSPKALDEGQVIVKRPLTALKLKNGEIENYYRPDSDRLLYEALKKRLSAFGGDGEKAFREPFYKPRRDGTPGPLVKKVKLAEPSTLNVAVHGGDGVADNGAMVRIDVFHVEGDGYYLVPIYVADTLKPELPRLACVAHKPYAKWKPMDDKDFCFSLYPNDLIRVAHRRGIKLSQVNKESSLPPTQERREAFLYYTSSDISSGTISCKNHDNTYQVGGLGIKTLEKLDKYTVDVLGEIHRVGREPRLPFTQKRS

SEQ ID NO: 11653 - protein, 632 aa, synthetic construct
MRRRLRRHRHRLERIRHLLVAENVISQAELDTLFEGRLEDIYALRVRALDAAVSMARDFAERSKMKKDMDANRARNEKIMERIRTEYGKETPTGQDLVKFKLWEEQHGECAYSQKHLSIEHLFDPDYAEVDHIVPYSISFDDSYMNKVLVLAEENRNKGNRLPLQYLQGRRREDFIVWVENSIHDPRKKRRLLKETITSEDEKKFRERNLQDTKTMSRFLLNYISDHLEFSAFATGRKKHVTAVNGTITSYMRKRWGITKIRENGDLHHAVDALVVACTTDVMIQQLSRYSALRECAYVQTETGSVAVSMHTGEVLKHFPYPWPEFRRELEARLGDDPRRAVISQRFPVYVNGDIPVRKLFVSRMPRRKVTGAAHKETVKSPKALNDGIVVVKRALTDLKLDPKTGEISNYYMPQSDRLLYEALKEELKKHGGDGSKAFAAPFHKPKSDGTPGPVVNKVKVCEPTTLNVPVLGGAGVADNDSMVRIDVFHVENDGYFFVPIYIADTLKAELPNKACVAHKPFEQWKEMSDENFVFSLYPNDLLRATHKTRLKLAKAQEDSTLPDTYETKQEMLYYISADIAAASITCRNHDNSYRIRGMGIKTLENLEKFTVDVLGEYHKVEKEPRMAFSRK

SEQ ID NO: 11654 - protein, 576 aa, synthetic construct
DFTERNRLKKEMDARGAENERIMERIRTEYGKAKPTGQDLVKYRLWCEQHEECAYSQKHISIEHLFDADYVEIDHIIPYSISFDDSYKNKVLVFAKENRDKGNRLPMQYLTGSRGDDFVVWVNNSVRDYRKRRLLLKEKLTEEDEKNFKERNLQDTKHMSAFLLNYIADNLEFAEFRSGRKKHVTAVSGMITSYMRKRWGIEKIRENGDLHHAVDALVIACTTDGMIQQASRYAELRECEYTHTAEGALAVSPRTGEVLRRFPYPWPGFKEELEARLGADPDKAVRDQCFPVYADGDIPVRPLFVSRMPRRKVSGAAHLETIKSAKALGDGVVIVKKDLTALKLDKDGEIANYYNPASDRLLYEALKARLAQFGGDAAKAFAEPFRKPKSDGTPGPIVKKVKLTEPTTLNVPVLGASAVADNDSMVRIDVFRVEGDGYYFVPVYVADTLKAELPNKACVAHKPYSEWKEMKPEDFVFSLYPNDLVRISHKRGFKLTIAQKESTLPASYETKSEMLYYISANISSGALSFRTHDASYEQGGLGIKTLESLEKFTVDVLGEYHRVEKEPRMGFGGRKR

SEQ ID NO: 11655 - protein, 1089 aa, synthetic construct
MHPYGIGLDIGVTSVGWAVLALDGEEKPRGIIDMGSRIFDAAEHPKTGASLALPRREARSARRRLRRHRHRKERIRELIVSSGLLGREELNSLFDGQLTDVYALRVKALDEKLSREEFARVLLHLAQRRGFRSNRKNAGDKEEGKLLEAVGENKKRMEAMVYRTAGEMLLKDETFARYKRNKGGQYIATITRDMTEDEARKIFAAQRSFGADFAGAELEEAYLEILLSQRSFDEGPGGESPYGGSQIGKMIGKCTFEEGELRAAKASYSFEYFTLLQKINHIRVLRGGDSRPLTAGEREKLIALAHKTENLNYLQIRKELGLSPEESFNTLRYSENIDLETAEKKEKFCYLKAYHQMRRAAERACKGSFAMLSREQRNAVGTVLSIYKSSAKIREGLAAAEIPDILIDQFEGLNFSKFGHLSVKACDRLIPYLEQGMNYNDACAAAGYDFRGHEGGEKHFTLPPLPDDQNEITSPVVLRAVSQTIKVVNAIIRKQGTSPTYINIELAREMAKDFSERKKLEKEMDENRARNERAMERIRNEYGKTDATGQDLVKLKLYEEQGGVCAYSQKQMSLARLFAPNYAEVDHIVPYSLSFDDSYKNKVLVLTEENRNKGNRLPLQYLTGQRRENFIVWVNSAVRDQRKKRLLLKEGFTPEDEQNFKERNLQDTKTMSRFLLNYIRDNLEFAPSDKGRKKRVTAVNGAVTSYMRKRWGITKIREDGDLHHAVDAVVIACTTDGMIQQLSRYAAFRECEYSQTEAGSVAVDPQTGEVLRQFPYPWPQFRKELEARLCNDPSRVIAGLRLPFYMEEDAPEARPLFVSRMPRRKVTGAAHKDTVKSAKAADEGLAIVKRPLTALKLDKDGEIADYYMPQSDRLLYEALKARLRQFGGDGAKAFAEPFYKPKSDGTPGPLVNKVKLCEPTTLNVPVQQDTAIADNDSMVRIDVFHVEGDGYYLVPIYVADTLKPELPSRACVAFKPYAEWKEMQEKDFIFSLYPNDLIRVTHKRGLKLTKVFKESTLPSTVEVKSEFLYYKGAGIAGAVISCINHDNTYEVKSLGIKTLEKLEKYTVDVLGEVHPVKKEKRQSFGGKGA

SEQ ID NO: 11656 - protein, 1087 aa, synthetic construct
MYPYAIGFDIGIASVGWAVVALDGEDRPFGIINMGSRVFDAAEQPKTGDSLAAPRREARSARRRLRRHQHRLERIRRLLAAEKVVSQAELDTLFEGKLEDIYALRVEALDAPVSNTGFARILLHIVQRRGFKSNRKSGTSKEDGELLAAVTANRALMSEKGYRTVGEMLLKDPQYSGNKRNKGGKYLATVGRDMVEEEVRAIFKAQREWGQPFAAAELEEQYLEILLSQRSFDEGPGQGSPYGGSQIEKMIGKCTLETGEPRAAKASYSFEYFTLLQNVNHLRLMSGGESSPLSSAQRETLIALAHKTKDLNFSRIRKELGIPAGTTFNAVFYKNAEDYEEAEKKTKFCYLRAYHQMRAAFNKLAKNHFDGLSRQQKNELGRVLSTYKTSANIRPRLAAAGLSEIEIDIAETMSFSKFGHLSVKACDKLIPFLEKGMKYDEACAAAGYDFKGHDGETRTRLLHPAEDDFADVTSPVVRRAISQTVKVLNAIIRERGGSPTFINIELAREMARDFAERSKMKKDMDENRARNERIMERIRTEYGKERPTGQDLVKFKLWEEQHGECAYSQKHISIERLFEPGYVEVDHIIPYSISFDDGYKNKVLVFTEENRNKSNRLPLQYLQGKRREDFTVWVESSIRDFRKKQRLLKETITAEDEKKFKERNLQDTKTMSRFLLNYISDHLEFADFASGRKKHVTAVNGAVTSYMRKRWGITKIRENGDLHHAVDALVVACTTDGMIQQVSRYAALRECEYVQTEAGSMAVSQHTGEVLRQFPYPWPEFRRELEARLGDDPRRAVISQRFPVYANGDIPVRKLFVSRMPRRKVTGAAHKETIKSPKALDSGNVVVKRALTDLKLDPKTGEIANYYMPQSDRLLYEALKEELKKHGGNGAKAFTAPFHKPKSDGTPGPVVNKVKLCEPTTLNVPVLKGAGVADNDSMVRIDVFHVENDGYYFVPIYIADTLKKELPNKACVAYKPYEQWKEMADKDFIFSLYPNDLLRVTHKTKLKLTKAQKESTLPDTYETKREMLYYISANIHTAAIGCRNHDNTYEIGGMGIKTLEKLEKFTVDVLGEYHKVEKEPRMAFCRK

SEQ ID NO: 11657 - protein, 1089 aa, synthetic construct
MHPYGIGLDIGVTSVGWAVLALDGEEKPRGIIDMGSRIFDAAEHPKTGASLALPRREARSARRRLRRHRHRKERIRELIVSSGLLGREELNSLFDGQLTDVYALRVKALDEKLSREEFARVLLHLAQRRGFRSNRKNAGDKEEGKLLEAVGENKKRMEAMVYRTAGEMLLKDETFARYKRNKGGQYIATITRDMTEDEARKIFAAQRSFGADFAGAELEEAYLEILLSQRSFDEGPGGESPYGGSQIGKMTGKCTFEEGELRAAKASYSFEYFTLLQKINHIRVLRGGDSRPLTAGEREKLIALAHKTENLNYLQIRKELGLSPEESFNTLRYSENIDLETAEKKEKFCYLKAYHQMRRAAERACKGSFAMLSREQRNAVGTVLSIYKSSAKIREGLAAAEIPDILIDQFEGLNFSKFGHLSVKACDRLIPYLEQGMNYNDACAAAGYDFRGHEGGEKHFTLPPLPDDQNEITSPVVLRAVSQTIKVVNAIIRKQGTSPTYINIELAREMAKDFSERKKLEKEMDENRARNERAMERIRNEYGKTDATGQDLVKLKLYEEQGGVCAYSQKQMSLARLFAPNYAEVDHIVPYSLSFDDSYKNKVLVLTEENRNKGNRLPLQYLTGQRRENFIVWVNSAVRDQRKKRLLLKEGFTPEDEQNFKERNLQDTKTMSRFLLNYIRDNLEFAPSDKGRKKRVTAVNGAVTSYMRKRWGITKIREDGDLHHAVDAVVIACTTDGMIQQLSRYAAFRECEYSQTEAGSVAVDPQTGEVLRQFPYPWPQFRKELEARLCNDPSRVIAGLRLPFYMEEDAPEARPLFVSRMPRRKVTGAAHKDTVKSAKAADEGLAIVKRPLTALKLDKDGEIADYYMPQSDRLLYEALKARLRQFGGDGAKAFAEPFYKPKSDGTPGPLVNKVKLCEPTTLNVPVQQDTAIADNDSMVRIDVFHVEGDGYYLVPIYVADTLKPELPSRACVAFKPYAEWKEMQEKDFIFSLYPNDLIRVTHKRGLKLTKVFKESTLPSTVEVKSEFLYYKGAGIAGAVISCINHDNTYEVKSLGIKTLEKLEKYTVDVLGEVHPVKKEKRQSFGGKGA

SEQ ID NO: 11658 - protein, 1089 aa, synthetic construct
MVPYAIGLDIGITSVGWATVALDRADRPYGILNMGVRIFDAAENPKTGASLAAPRREARSARRRLRRHRHRNERIRNLLVSSKVITEDELAHLFDGKLPDIYALRVRALDEPVTNREFTRILIHLAQRRGFRSNRIGASSKEDGELLSAVSENRKLMVQNGYRTIGEMYLKDERFREHQRNKGGQYIGTVSRDMVKEEVHLVFAAQRKLGSGFAAEKLEEAYLAILLSQRSFDEGPGEGSPYAGSQIARMIGKCTLIPEESRAARATYSFEYFSLLSAVNHIRLVSGKTSAPLSAEQRRTLIELAHKSADLNYGRLRKELALSDDQTFNTVSYRKGEERDESEKKSKFVQMKAYHEMRKAFERAAKGHFADISMEQRNSIGETLSKYKTHDKIVPELKNAGLSDEDIAIAETLSFSKFGHLSIKACDLLIPFLEQGMKYNEACDAAGLNFKGHDRETKSNKLPALDEDAKNTITSPVVQRAVSQTIKVVNAIIRERGQQPTFINIELAREMSKDITERRQLEKEQKENSSRNARLMEQIRKEYKKTSPTGLDLVKMKLWEEQGGICAYSQKPISIEHLFDENYAEVDHIIPYSISFDDGYKNKVLVLAKENRDKGNRLPLEYLTGKQREDFIVWVNSSVRDYRKRQRLLKEHLTKDDESGFIERNLQDTKTASVFLMNYIRDHLAFAPFQGKGEKHVTAVNGSVTAYMRKRWGISKVRANGDLHHAVDALVIACTTDAFIQKVSRYAKYRESRFMKEAAERFLVDPDTGEIIQEFPYPWPNFRQELEARLSRDPASAMEQLKYPILTPEEGEIKPIFVSRMPKHKVTGAAHLETVKSGKALDEGFLIVKKALTELSLDKDGEIKNYYHPQSDRLLYEALKARLQQFSGDGKKAFSEPFHKPKHDGTPGPLVNKVKLCEPSTIQVPVLGGNGMANNDSMVRIDVYHIDGDGYYFVPIYVADTLKPVLPNKACVANKPYPKWKPMREDSFVFSLYPNDLIRIVHRKGMKLALSQKDSDLDEFYQTKDIMLYLVSASISTASLKCETHDAAYQISSLGIKTLDCLEKYTVDVLGNYSAVKRETRQHFPGQKD

SEQ ID NO: 11659 - protein, 1087 aa, synthetic construct
MYPYAIGFDIGIASVGWAVVALDGEDRPFGIINMGSRVFDAAEQPKTGDSLAAPRREARSARRRLRRHQHRLERIRRLLAAEKVVSQAELDTLFEGKLEDIYALRVEALDAPVSNTGFARILLHIAQRRGFKSNRKSGTSKEDGELLAAVTANRALMSEKGYRTVGEMLLKDPQYSGNKRNKGGKYLATVGRDMVEEEVRAIFKAQREQGQPFAAAELEEQYLEILLSQRSFDEGPGQGSPYGGSQIEKMIGKCTLETGEPRAAKASYSFEYFTLLQNVNHLRLMSGGESSPLSSAQRETLIALAHKTKDLNFSRIRKELGIPAGTTFNTVSYKNAEDYEEAEKKTKFCYLRAYHQMRAAFNKLAKNHFDGLSRQQKNELGRVLSTYKTSANIRPRLAAAGLSEIEIDIAETMSFSKFGHLSVKACDKLIPFLEKGMKYDEACAAAGYDFKGHDGETRTRLLHPAEDDFADVTSPVVRRAISQTVKVLNAIIRERGGSPTFINIELAREMARDFAERSKMKKDMDENRARNERIMERIRTEYGKERPTGQDLVKFKLWEEQHGECAYSQKHISIERLFEPGYVEVDHIIPYSISFDDGYKNKVLVFTEENRNKSNRLPLQYLQGKRREDFTVWVESSIRDFRKKQRLLKETITAEDEKKFKERNLQDTKTMSRFLLNYISDHLEFADFASGRKKHVTAVNGAVTSYMRKRWGITKIRENGDLHHAVDALVVACTTDGMIQQVSRYAALRECEYVQTEAGSMAVSQHTGEVLRQFPYPWPEFRRELEARLGDDPRRAVISQRFPVYANGDIPVRKLFVSRMPRRKVTGAAHKETIKSPKALDSGNVVVKRALTDLKLDPKTGEIANYYMPQSDRLLYEALKEELKKHGGNGAKAFTAPFHKPKSDGTPGPVVNKVKLCEPTTLNVPVLKGAGVADNDSMVRIDVFHVENDGYYFVPIYIADTLKKELPNKACVAYKPYEQWKEMADKDFIFSLYPNDLLRVTHKTKLKLTKAQKESTLPDTYETKREMLYYISANIHTAAIGCRNHDNTYEIGGMGIKTLEKLEKFTVDVLGEYHKVEKEPRMAFCRK

SEQ ID NO: 11660 - protein, 1087 aa, synthetic construct
MYPYAIGFDIGIASVGWAVVALDGEDRPFGIINMGSRVFDAAEQPKTGDSLAAPRREARSARRRLRRHQHRLERIRRLLAAEKVVSQAELDTLFEGKLEDIYALRVEALDAPVSNTGFARILLHIAQRRGFKSNRKSGTSKEDGELLAAITANRALMSEKGYRTVGEMLLKDPQYSGNKRNKGGKYLTTVGRDMVEEEVRAIFKAQREQGQPFAAAELEEQYLEILLSQRSFDEGPGQGSPYGGSQIEKMIGKCTLETGEPRAAKASYSFEYFTLLQNVNHLRLMSGGESSPLSSAQRETLIALAHKTKDLNFSRIRKELGIPAGTIFNTVSYKNAEDYEEAEKKTKFCYLRAYHQMRAAFNKLAKNHFDGLSRQQKNELGRVLSTYKTSANIRPRLAAAGLSEIEIDIAETMSFSKFGHLSVKACDKLIPFLEKGMKYDEACAAAGYDFKGHDGETRTRLLHPAEDDFADVTSPVVRRAISQTVKVLNAIIRERGGSPTFINIELAREMARDFAERSKMKKDMDENRARNERIMERIRTEYGKERPTGQDLVKFKLWEEQHGECAYSQKHISIERLFEPGYVEVDHIIPYSISFDDGYKNKVLVFTEENRNKSNRLPLQYLQGKRREDFTVWVESSIRDFRKKQRLLKETITAEDEKKFKERNLQDTKTMSRFLLNYISDHLEFADFASGRKKHVTAVNGAVTSYMRKRWGITKIRENGDLHHAVDALVVACTTDGMIQQVSRYAALRECEYVQTEAGSMAVSQHTGEVLRQFPYPWPEFRRELEARLGDDPRRAVISQRFPVYANGDIPVRKLFVSRMPRRKVTGAAHKETIKSPKALDSGNVVVKRALTDLKLDPKTGEIANYYMPQSDRLLYEALKEELKKHGGNGAKAFTAPFHKPKSDGTPGPVVNKVKLCEPTTLNVPVLKGAGVADNDSMVRIDVFHVENDGYYFVPIYIADTLKKELPNKACVAYKPYEQWKEMADKDFIFSLYPNDLLRVTHKTKLKLTKAQKESTLPDTYETKQEMLYYISANIHTAAIGCRNHDNTYEIGGMGIKTLEKLEKYTVDVLGEYHKVEKEPRMAFCRK

SEQ ID NO: 11661 - protein, 1087 aa, synthetic construct
MYPYAIGFDIGIASVGWAVVALDGEDRPFGIINMGSRVFDAAEQPKTGDSLAAPRREARSARRRLRRHQHRLERIRRLLAAEKVVSQAELDTLFEGKLEDIYALRVEALDAPVSNTGFARILLHIVQRRGFKSNRKSGTSKEDGELLAAVTANRALMSEKGYRTVGEMLLKDPQYSGNKRNKGGKYLATVGRDMVEEEVRAIFKAQREQGQPFAAAELEEQYLEILLSQRSFDEGPGQGSPYGGSQIEKMIGKCTLETGEPRAAKASYSFEYFTLLQNVNHLRLMSGGESSPLSSAQRETLIALAHKTKDLNFSRIRKELGIPAGTTFNAVFYKNAEDYEEAEKKTKFCYLRAYHQMRAAFNKLAKNHFDGLSRQQKNELGRVLSTYKTSANIRPRLAAEGLSEIEIDIAETMSFSKFGHLSVKACDKLIPSLEKGMKYDEACAAAGYDFKGHDGETRTRLLHPAEDDFADVTSPVVRRAISQTVKVLNAIIRERGGSPTFINIELAREMARDFAERSKMKKDMDENRARNERIMERIRTEYGKERPTGQDLVKFKLWEEQHGECAYSQKHISIERLFEPGYVEVDHIIPYSISFDDGYKNKVLVFTEENRNKSNRLPLQYLQGKRREDFTVWVESSIRDFRKKQRLLKETITAEDEKKFKERNLQDTKTMSRFLLNYISDHLEFADFASGRKKHVTAVNGAVTSYMRKRWGITKIRENGDLHHAVDALVVACTTDGMIQQVSRYAALRECEYVQTEAGSMAVSQHTGEVLRQFPYPWPEFRRELEARLGDDPRRAVISQRFPVYANGDIPVRKLFVSRMPRRKVTGAAHKETIKSPKALDSGNVVVKRALTDLKLDPKTGEIANYYMPQSDRLLYEALKEELKKHGGNGAKAFTAPFHKPKSDGTPGPVVNKVKLCEPTTLNVPVLKGAGVADNDSMVRIDVFHVENDGYYFVPIYIADTLKKELPNKACTRGKPYAEWKEMDAEDFLFSLYPNDLIRVTSQKGLTLSKAQKESTLPDTYETKQEMLYYISAGISVAAIACRTHDSSYEIRSMGIKTLEKLEKFTVDVLGEYHKVVKEPRMAFCRK

SEQ ID NO: 11662 - protein, 1087 aa, synthetic construct
MYPYAIGFDIGIASVGWAVVALDGEDRPFGIISMGSRIFDAAEQPKTGDSLAAPRREARSARRRLRRHQHRLERIRRLLVSKKIVSQAELDTLFDGKLEDIYALRVKALDVPVSNTGFARILLHIAQRRGFRSNRKSGTSKEDGELLAAVTANRALMSERGYRTVGEMLLKDPQYSANKRNKGGKYLATVGRDMVEEEVRAIFTAQRELGQAFASTELEEQYLEILLSQRSFDEGPGQGSPYGGSQIEKMIGKCTLEAGEPRAAKASYSFEYFTLLQNVNHLRLMSRGESNPLSDVQRETLIALAHKTNGLNFSRIRKELEIPADTTFNAVSYKNAEDYEEAEKKTKFCYLRAYHQMRAAFNKLAKNHFDGLSRQQKNELGRVLSTYKTSTNIRPRLAAVGLSEREIDIAETMSFRKFGHLSVKACNKLIPFLEKGMKYDEACTAAGYDFQGHDGRTRTRLLHPTEDDFADVTSPVVRRAISQTVKVLNAIIRERGGSPTFINIELAREMARDFAERSKMKKDMDENRTRNERLMERIRTEYGRERPTGQDLVKFKLWEEQHGECAYSQKHISIERLFEPGYVEVDHIIPYSISFDDGYKNKVLVFTEENRSKSNRLPLQYLQGKRREDFIVWVESSIRDFRKKQRLLKEAITAEDERKFKERNLQDTKTMSRFLLNYISDHLEFADFASGRKKHVTAVNGAVTSYMRKRWGITKLRENGDLHHAVDALVIACTTDGMIQQVSRYAALRECEYVQTEAGSMAVSQHTGEVLRQFPYPWAEFRRETEARLGDDPRRAVISQRFPVYVNGDIPVRKLFVSRMPRRKVTGAAHRETIKSPKALEDGVVVVKRALTDLKLDPKTGEIANYYMPQSDRLLYEALKEELKKHGGNGAKAFAEPFHKPKSDGTPGPVVNKVKLCEPTTLNVPVLRGSGVADNDSMVRIDVFHVENDGYYFVPIYIADTLKTELPNKACVAHKPYEQWKEMDGKDFIFSLYPNDLFRATHKTKLKLTKAQKESTLPDTCEAKQEMLYYIGANIHTAAIGCRNHDNTYEIGGMGIKTLEKLEKYTVDVLGEYHKVEKEPRMAFCRK

SEQ ID NO: 11663 - protein, 1087 aa, synthetic construct
MYPYAIGFDIGIASVGWAVVALDGEDRPFGIINMGSRVFDAAEQPKTGDSLAAPRREARSARRRLRRHQHRLERIRRLLAAEKVVSQAELDTLFEGKLEDIYALRVEALDAPVSNTGFARILLHIAQRRGFKSNRKSGTSKEDGELLAAVTANRALMSEKGYRTVGEMLLKDPQYSGNKRNKGGKYLTTVGRDMVEEEVRAIFKAQREQGQPFAAAELEEQYLEILLSQRSFDEGPGQGSPYGGSQIEKMIGKCTLETGEPRAAKASYSFEYFTLLQNVNHLRLMSGGESSPLSSAQRETLIALAHKTKDLNFSRIRKELGIPAGTTFNTVSYKNAEDYEEAEKKTKFCYLRAYHQMRAAFNKLAKNHFDGLSRQQKNELGRVLSTYKTSANIRPRLAAAGLSEIEIDIAETMSFSKFGHLSVKACDKLIPFLEKGMKYDEACAAAGYDFKGHDGETRTRLLHPAEDDFADVTSPVVRRAISQTVKVLNAIIRERGGSPTFINIELAREMARDFAERSKMKKDMDENRARNERIMERIRTEYGKERPTGQDLVKFKLWEEQHGECAYSQRHISIERLFEPGYVEVDHIIPYSISFDDGYKNKVLVFTEENRNKSNRLPLQYLQGKRREDFTVWVESSIRDFRKKQRLLKETITAEDEKKFKERNLQDTKTMSRFLLNYISDHLEFADFASGRKKHVTAVNGAVTSYMRKRWGITKIRENGDLHHAVDALVVACTTDGMIQQVSRYAALRECEYVQTEAGSMAVSQHTGEVLRQFPYPWPEFRRELEARLGDDPRRAVISQRFPVYANGDIPVRKLFVSRMPRRKVTGAAHKETIKSPKALDSGNVVVKRALTDLKLDPKTGEIANYYMPQSDRLLYEALKEELKKHGGNGAKAFTAPFHKPKSDGTPGPVVNKVKLCEPTTLNVPVLKGAGVADNDSMVRIDVFHVENDGYYFVPIYIADTLKKELPNKACVAYKPYEQWKEMADKDFIFSLYPNDLLRVTHKTKLKLTKAQKESTLPDTYETKQEMLYYISANIHTAAIGCRNHDNTYEIGGMGIKTLEKLEKFTVDVLGEYHKVEKEPRMAFCRK

SEQ ID NO: 11664 - protein, 1089 aa, synthetic construct
MHPYGIGLDIGVTSVGWAVLALDGEEKPRGIIDMGSRIFDAAEHPKTGASLALPRREARSARRRLRRHRHRKERIRELIVSSGLLGRDELDRLFDGQLTDVYALRVKALDEKLSREEFTRVLLHLAQRRGFRSNRKNAGDKEEGKLLEAVGENKKRMEAMVYRTAGEMLLKDETFARYKRNKGGQYIATITRDMTEDEARKIFAAQRSFGADFAGAELEEAYLEILLSQRSFDEGPGGESPYGGSQIGKMIGKCTFEEGELRAARASYSFEYFTLLQKINHIRVLRGGDSRPLTAGEREKLIALAHKTENLNYLQIRKELGLSPEESFNTLRYSENIDLETAEKKEKFCYLKAYHQMRRAAERACKGSFAMLSREQRNAVGTVLSIYKSSAKIREGLAAAEIPDILIDQFEGLNFSKFGHLSVKACNRLIPYLEQGMNYNDACAAAGYDFRGHEGGEKHFTLPPLPDDQNEITSPVVLRAVSQTIKVVNAIIRKQGTSPTYINIELAREMAKDFSERKKLEKEMDENRARNERAMERIRNEYGKTDATGQDLVKLKLYEEQGGVCAYSQKQMSLARLFAPNYAEVDHIVPYSLSFDDSYKNKVLVLTEENRNKGNRLPLQYLTGQRRENFIVWVNSAVRDQRKKRLLLKEGFTPEDEQNFKERNLQDTKTMSRFLLNYIRDNLEFAPSDKGRKKRVTAVNGAVTSYMRKRWGITKIREDGDLHHAVDAVVIACTTDGMIQQLSRYAAFRECEYSQTEAGSVAVDPQTGEVLRQFPYPWPQFRKELEARLCNDPSRVIAGLRLPFYMEEDAPEARPLFVSRMPRRKVTGAAHKDTVKSAKAADEGLAIVKRPLTALKLDKDGEIADYYMPQSDRLLYEALKARLRQFGGDGAKAFAEPFYKPKSDGTPGPLVNKVKLCEPTTLNVPVQQDTAIADNDSMVRIDVFHVEGDGYYLVPIYVADTLKPELPSRACVAFKPYAEWKEMQEKDFIFSLYPNDLIRVTHKRGLKLTKVFKESTLPSTVEVKSEFLYYKGAGIAGAVISCINHDNTYEVKSLGIKTLEKLEKYTVDVLGEVHPVKKEKRQSFGGKGA

SEQ ID NO: 11665 - protein, 1087 aa, synthetic construct
MYPYAIGFDIGIASVGWAVVALDGEDRPFGIINMGSRVFDAAEQPKTGDSLAAPRREARSARRRLRRHQHRLERIRRLLAAEKVVSQAELDTLFEGKLEDIYALRVEALDAPVSNTGFARILLHIAQRRGFKSNRKSGTSKEDGELLAAVTANRALMSEKGYRTVGEMLLKDPQYSGNKRNKGGKYLTTVGRDMVEEEVRAIFKAQREQGQPFAAAELEEQYLEILLSQRSFDEGPGQGSPYGGSQIEKMIGKCTLETGEPRAAKASYSFEYFTLLQNVNHLRLMSGGESSPLSSAQRETLIALAHKTKDLNFSRIRKELGIPAGTTFNTVSYKNAEDYEEAEKKTKFCYLRAYHQMRAAFNKLAKNHFDGLSRQQKNELGRVLSTYKTSANIRHRLAAAGLSEIEIDIAETMSFSKFGHLSVKACDKLIPFLEKGMKYDKACAAAGYDFKGHDGETRTRLLHPAEDDFADVTSPVVRRAISQTVKVLNAIIRERGGSPTFINIELAREMARDFAERSKMKKDMDENRARNERIMERIRTEYGKERPTGQDLVKFKLWEEQHGECAYSQKHISIERLFEPGYVEVDHIIPYSISFDDGYKNKVLVFTEENRNKSNRLPLQYLQGKRREDFTVWVESSIRDFRKKQRLLKETITAEDEKKFKERNLQDTKTMSRFLLNYISDHLEFADFASGRKKHVTAVNGAVTSYMRKRWGITKIRENGDLHHAVDALVVACTTDGMIQQVSRYAALRECEYVQTEAGSMAVSQHTGEVLRQFPYPWPEFRRELEARLGDDPRRAVISQRFPVYANGDIPVRKLFVSRMPRRKVTGAAHKETIKSPKALDSGNVVVKRALTDLKLDPKTGEIANYYMPQSDRLLYEALKEELKKHGGNGAKAFTAPFHKPKSDGTPGPVVNKVKLCEPTTLNVPVLKGAGVADNDSMVRIDVFHVENDGYYFVPIYIADTLKKELPNKACVAYKPYEQWKEMADKDFIFSLYPNDLLRVTHKTKLKLTKAQKESTLPDTYETKQEMLYYISANIHTAAIGCRNHDNTYEIGGMGIKTLEKLEKFTVDVLGEYHKVEKEPRMAFCRK

SEQ ID NO: 11666 - protein, 1087 aa, synthetic construct
MYPYAIGFDIGIASVGWAVVALDGEDRPFGIINMGSRVFDAAEQPKTGDSLAAPRREARSARRRLRRHQHRLERIRRLLAAEKVVSQAELDTLFEGKLEDIYALRVEALDAPVSNTGFARILLHIAQRRGFKSNRKSGTSKEDGELLAAVTANRALMSEKGYRTVGEMLLKDPQYSGNKRNKGGKYLATVGRDMVEEEVRAIFKAQREWGQPFAAAELEEQYLEILLSQRSFDEGPGQGSPYGGSQIEKMIGKCTLETGEPRAAKASYSFEYFTLLQNVNHLRLMSGGESSPLSSAQRETLIALAHKTKDLNFSRIRKELGIPAGTTFNAVFYKNAEDYEEAEKKTKFCYLRAYHQMRAAFNKLAKNHFDGLSRQQKNELGRVLSTYKTSANIRPRLAAAGLSEIEIDIAETMSFSKFGHLSVKACDKLIPFLEKGMKYDKACAAAGYDFKGHDGETRTRLLHPAEDDFADVTSPVVRRAISQTVKVLNAIIRERGGSPTFINIELAREMARDFAERSKMKKDMDENHARNERIMERIRTEYGKERPTGQDLVKFKLWEEQHGECAYSQRHISIERLFEPGYVEVDHIIPYSISFDDGYKNKVLVFTEENRNKSNRLPLQYLQGKRREDFTVWVESSIRDFRKKQRLLKETITAEDEKKFKERNLQDTKTMSRFLLNYISDHLEFADFASGRKKHVTAVNGAVTSYMRKRWGITKIRENGDLHHAVDALVVACTTDGMIQQVSRYAALRECEYVQTEAGSMAVSQHTGEVLRQFPYPWPEFRRELEARLGDDPRRAVISQRFPVYANGDIPVRKLFVSRMPRRKVTGAAHKETIKSPKALDSGNVVVKRALTDLKLDPKTGEIANYYMPQSDRLLYEALKEELKKHGGNGAKAFTAPFHKPKSDGTPGPVVNKVKLCEPTTLNVPVLKGAGVADNDSMVRIDVFHVENDGYYFVPIYIADTLKKELPNKACVAYKPYEQWKEMADKDFIFSLYPNDLLRVTHKTKLKLTKAQKESTLPDTYETKQEMLYYISANIHTAAIGCRNHDNTYEIGGMGIKTLEKLEKFTVDVLGEYHKVEKEPRMAFCRK

SEQ ID NO: 11667 - protein, 1087 aa, synthetic construct
MYPYAIGFDIGITSVGWAVVALDGEDNPFGIINMGSRIFDAAEQPKTGASLAAPRREARSMRRRLRRHRHRLERIRHLLVAENVISQAELDALFEGKLEDIYTLRVKALDTAVSHADFARILLHIAQRRGFKSNRKSGTSKEDGELLAAVSANRALMVEKGYRTVGEMLLKDPQYSGSKRNKGGKYLATVGRDMVEEEVRAIFKAQREQGQAFAAAELEEQYLEILLSQRSFDEGPGEGSPYRGSQIEKMIGKCTLEAGEPRAAKASYSFEYFTLLQNINHLRLICGGESRPLSDAQRKFLIALAHKTKDLNFSRIRKELDIPADTTFNAVSYKSADGYEDAEKKAKFCYLKAYHQMKAAFNRLSKGHFDSLTRQQKNELGRVLSTYKTSANIRPRLAAAGLSEMEIDIAETMSFSKFGHISVKACDKLIPFLEKGLKYNDACAAAGYDFKGHDSETRTRLLHPTEDDFADVTSPVVRRAISQTVKVLNAIIRERGNSPTFINIELAREMARDFTERSKMKKDMDENRARNERIMERIRTEYGKEHPTGQDLVKFKLWEEQHGECAYSQKHLSLKHLFDPDYAEVDHIIPYSISFDDGYKNKVLVLAEENRNKGNRLPLQYLQGERRDDFIVWVENSIHDYRKKQRLLKETITAEDEKGFKERNLQDTKTMSRFLLNYISDHLEFSDFSTGRKKHVTAVNGAITSYLRKRWGIAKIRENGDLHHAVDALVVVCTTDGMIQQLSRYSTLRECEYVQTEAGSIAVSMHTGEVLKRFPYPWPEFRRELEARLGDDPRRAVISQRFPVYANGDIPVRKLFVSRMPRRKVTGAAHKETIKSPKALNDGIVVVKRALTDLKLDPKTGEISNYYMPQSDRLLYEALKEALKKHGGNATKAFAAPFHKPKSDGTPGPVVNKIKLCEPTTLNVAVLNGAGVADNDSMVRIDVFHVENDGYYFVPIYIADTLKKELPNKACTRGKPYAEWKEMDAEDFLFSLYPNDLIRVTSQKGLTLSKAQKESTLPDTYETKQEMLYYTSASINTAAVACRTHDNSYEIKSMGIKTLEKLEKFTVDVLGEYHKVEKEPRMAFCRK

SEQ ID NO: 11668 - protein, 1087 aa, synthetic construct
MYPYAIGFDIGITSVGWAVVALDGEDKPFGIINMGSRIFDAAEQPKTGASLAAPRREARSMRRRLRRHRHRLERIRHLLVAENVISQAELNALFEGKLEDIYTLRVKALDTAVSHADFARILLHIAQRRGFKSNRKSGTSKEDGELLAAVSANSALMVEKGYRTVGEMLLKDPQYSGSKRNKGGKYLATVGRDMVEEEVRAIFKAQREQGQAFAAAELEEQYLEILLSQRSFDEGPGEGSPYRGSQIEKMIGKCTLEAGEPRAAKASYSFEYFTLLQNINHLRLICGGESRPLSDAQREFLIALAHKTKDLNFSRIRKELDIPADTTFNAVSYKSADGYEDAEKKAKFCYLKAYHQMKAAFNRLSKGHFDSLTRQQKNELGRVLSTYKTSANIRPRLAAAGLSEMEIDIAETMSFSKFGHISVKACDKLIPFLEKGLKYNDACAAAGYDFKGHDSETRTRLLHPTEDDFADVTSPVVRRAISQTAKVLNAIIRERGNSPTFINIELAREMARDFTERSKMKKDMDENRARNERIMERIRTEYGKEHPTGQELVKFKLWEEQHGECAYSQKHLSLEHLFDPNYAEVDHIIPYSISFDDGYKNKVLVLAEENRNKGNRLPLQYLQGERRDDFIVWVENSIHDYRKKQRLLKETITAEDEKGFKERNLQDTKTMSRFLLNYISDHLEFSDFSTGRKKHVTAVNGAITSYLRKRWGIAKIRENSDLHHAVDALVVVCTTDGMIQQLSRYSTLRECEYVQTEAGSIAVSMHTGEVLKRFPYPWPEFRRELEARLGDDPRRAVISQRFPVYANGDIPVRKLFVSRMPRRKVTGAAHKETIKSPKALNDGVVVVKRALTDLKLDPKTGEISNYYMPQSDRLLYEALKEALKKHGGDAAKAFAAPFHKPKSDGTPGPVVNKVKLCEPTTLNVAVLNGAGVADNDSMVRIDVFHVENDGYYFVPIYIADTLKKELPNKACTRGKPYAEWKEMDAEDFLFSLYPNDLIRVTSQKGLTLSKAQKESTLPDTYETKQEMLYYTSASINTAAVACRTHDNSYEIKSMGIKTLEKLEKFTVDVLGEYHKVEKEPRMAFCRK

SEQ ID NO: 11669 - protein, 1087 aa, synthetic construct
MYPYAIGFDIGITSVGWAVVALDGEDKPFGIINMGSRIFDAAEQPKTGASLAAPRREARSMRRRLRRHRHRLERIRHLLVAENVISQAELDALFEGKLEDIYTLRVKALDTAVSHADFARILLHIAQRRGFKSNRKSGTSKEDGELLTAVSANRALMAEKGYRTVGEMLLKDPQYSGSKRNKGGKYLATVGRDMVEEEVRAIFKAQREQGQAFAATELEEQYLEILLSQRSFDEGPGEGSPYRGSQIEKMIGKCTLEAGEPRAAKASYSFEYFTLLQNINHLRLICGGESRPLSDAQREFLIALAHKTKDLNFSRIRKELDIPADTTFNAVSYKSADGYEDAEKKAKFCYLKAYHQMKAAFNKLSKGHFDSLARQQKNELGRVLSTYKTSANIRPRLAAAGLSEMEIDIAETMSFSKFGHISVKACDKLIPFLEKGLKYNDACAAAGYDFKGHDSETRTRLLHPTEDDFADVTSPVVRRAISQTVKVLNAIIRERGNSPTFINIELAREMARDFTERSKMKKDMDENRARNERIMERIRTEYGKEHPTGQDLVKFKLWEEQHGECAYSQKHLSLEHLFDPDYAEVDHIIPYSISFDDGYKNKVLVLAEENRNKGNRLPLQYLQGERRDDFIVWVENSIHDYRKKQRLLKEAITAEDEKGFKERNLQDTKTMSRFLLNYISDHLEFSDFSTGRKKHVTAVNGAITSYLRKRWGIAKIRENGDLHHAVDALVVACTTDGMIQQLSRYSTLRECEYVQTEAGSIAVSMHTGEVLKHFPYPWPEFRRELEARLGDDPRRAVISQRFPVYANGDIPVRKLFVSRMPRRKVTGAAHKETIKSPKALNDGIVVVKRALTDLKLDPKTGEISNYYMPQSDRLLYEALKEALKKHGGDAAKAFAAPFHKPKSDGTPGPVVNKIKLCEPTTLNVSVLNGAGVADNDSMVRIDVFRVENDGYYFVPIYIADTLKKELPNKACVAYKPYEQWKEMSDDNFIFSLYPNDLLRVTHKTKLKLTEAQKESTLPDTYETKQEMLYYFSANIHTAAIGCRNHDNTYEIGGMGIKTLEKLEKFTVDVLGEYHKVEKEPRMAFCRK

SEQ ID NO: 11670 - protein, 1089 aa, synthetic construct
MHPYGIGLDIGVTSVGWAVLALDGEEKPRGIIDMGSRIFDAAEHPKTGASLALPRREARSARRRLRRHRHRKERIRELIVSSGLLGRDELDRLFDGQLTDVYALRVKALDEKLSREEFTRVLLHLAQRRGFRSNRKNAGDKEEGKLLEAVGENKKRMEAMGYRTAGEMLLKDETFARYKRNKGGQYIATITRDMTEDEARKIFAAQRSFGADFAGAELEEAYLEILLSQRSFDEGPGGESPYGGSQIGKMIGKCTFEEGELRAARASYSFEYFTLLQKINHIRVLRGGDSRPLTAGEREKLIALAHKTENLNYLQIRKELGLSPEESFNTLRYSENIDLETAEKKEKFCYLKAYHQMRRAAERACKGSFAMLSREQRNAVGTVLSIYKSSAKIREGLAAAEIPDILIDQFEGLNFSKFGHLSVKACNRLIPYLEQGMNYNDACAAAGYDFRGHEGGEKHFTLPPLPDDQNEITSPVVLRAVSQTIKVVNAIIRKQGTSPTYINIELAREMARDFSERKKLEKEMDENRARNERAMERIRNEYGKTDATGQDLVKLKLYEEQGGVCAYSQKQMSLARLFAPNYAEVDHIVPYSLSFDDSYKNKVLVLTEENRNKGNRLPLQYLTGQRRENFIVWVNSAVRDQRKKRLLLKEGFTPEDEQNFKERNLQDTKTMSRFLLNYIRDNLEFAPSDKGRKKRVTAVNGAVTSYMRKRWGITKIREDGDLHHAVDAVVIACTTDGMIQQLSRYAAFRECEYSQTEAGSVAVDPQTGEVLRQFPYPWPQFRKELEARLCNDPSRVIAGLRLPFYMEEDAPEARPLFVSRMPRRKVTGAAHKDTVKSAKAVDEGLAIVKRPLSALKLDKDGEIAGYYMPQSDRLLYEALKTRLRQFGGDGAKAFAEPFYKPKSDGTPGPLVNKVKLCEPTTLNVPVQQDTAIADNDSMVRIDVFHVEGDGYYFVPIYVADTLKPVLPNRACVAFKPYAEWKEMKEEDFIFSLYPNDLIRVTHKRGLKLTKVFKESTLPSTVEVKCEFMYYKGAGIAGAVISCINHDNTYEVKSLGIKTLEKLEKYTVDVLGEVHPVKKEKRQSFGGKGA

SEQ ID NO: 11671 - protein, 1087 aa, synthetic construct
MYPYAIGFDIGIASVGWAVVALDGEDRPFGIINMGSRVFDAAEQPKTGDSLAAPRREARSARRRLRRHQHRLERIRRLLAAEKVVSQAELDTLFEGKLEDIYALRVEALDAPVSNTGFARILLHIAQRRGFKSNRKSGTSKEDGELLAAVTANRALMSEKGYRTVGEMLLKDPQYSGNKRNKGGKYLATVGRDMVEEEVRAIFKAQRERGQPFAAAELEEQYLEILLSQRSFDEGPGQGSPYGGSQIEKMIGKCTLETGEPRAAKASYSFEYFTLLQNVNHLRLMSGGESSPLSSAQRETLIALAHKTKDLNFSRIRKELGISAGTTFNAVFYKNAEDYEEAEKKTKFCYLRAYHQMRAAFNKLAKNHFDGLSRQQKNELGRVLSTYKTSANIRPRLAAAGLSEIEIDIAETMSFSKFGHLSVKACDKLIPFLEKGMKYDEACAAAGYDFNGHDGETRTRLLHPAEDDFADVTSPVVRRAISQTVKVLNAIIRERGGSPTFINIELAREMARDFAERSKMKKDMDENRARNERIMERIRTEYGKERPTGQDLVKFKLWEEQHGECAYSQKHISIERLFEPGYVEVDHIIPYSISFDDGYKNKVLVFTEENRNKSNRLPLQYLQGKRREDFTVWVESSIRDFRKKQRLLKETITAEDEKKFKERNLQDTKTMSRFLLNYISDHLEFADFASGRKKHVTAVNGAVTSYMRKRWGITKIRENGDLHHAVDALVVACTTDGMIQQVSRYAALRECEYVQTEAGSMAVSQHTGEVLRQFPYPWPEFRRELEARLGDDPRRAVISQRFPVYANGDIPVRKLFVSRMPRRKVTGAAHKETIKSPKALDSGNVVVKRALTDLKLDPKTGEIANYYMPQSDRLLYEALKEELKKHGGNGAKAFTAPFHKPKSDGTPGPVVNKVKLCEPTTLNVPVLKGAGVADNDSMVRIDVFHVENDGYYFVPIYIADTLKKELPNKACVAYKPYEQWKEMADKDFIFSLYPNDLLRVTHKTKLKLTKAQKESTLPDTYETKREMLYYISANIHTAAIGCRNHDNTYEIGGMGIKTLEKLEKFTVDVLGEYHKVEKEPRMAFCRK

SEQ ID NO: 11672 - protein, 1087 aa, synthetic construct
MYPYAIGFDIGITSVGWAVVALDGEDKPFGIINMGSRIFDAAEQPKTGASLAAPRREARSMRRRLRRHRHRLERIRHLLVAENVISQAELDALFEGKLEDIYTLRVKALDTAVSHADFARILLHIAQRRGFKSNRKSGTSKEDGELLTAVSANRALMAEKGYRTVGEMLLKDPQYSGSKRNKGGKYLATVGRDMVEEEVRAIFKAQREQGQAFAATELEEQYLEILLSQRSFDEGPGEGSPYRGSQIEKMIGKCTLEAGEPRAAKASYSFEYFTLLQNINHLRLICGGKSRPLSDAQREFLIALAHKTKDLNFSRIRKELDIPADTTFNAVSYKSADGYEDAEKKAKFCYLKAYHQMKAAFNRLSKGHFDSLARQQKNELGRVLSTYKTSANIRPRLAAAGLSEMEIDIAETMSFSKFGHISVKACDKLIPFLEKGLKYNDACAAAGYDFKGHDSETRTRLLHPTEDDFADVTSPVVRRAISQTVKVLNAIIRERGNSPTFINIELAREMARDFTERSKMKKDMDENRARNEWIMERIRTEYGKEHPTGQDLVKFKLWEEQHGECAYSQKHLSLKHLFDSDYAEVDHIIPYSISFDDGYKNKVLVLAEENRNKGNRLPLQYLQGERRDDFIVWVENSIHDYRKKQRLLKETITAEDEKGFKERNLQDTKTMSRFLLSYISDHLEFSDFSTGRKKHVTAVNGAITSYLRKRWGIAKIRENGDLHHAVDALVVACTTDGMIQQLSRYSTLRECEYVQTEAGSIAVSMHTGEVLKRFPYPWPEFRRELEARLGDDPRRAVISQRFPVYANGDIPVRKLFVSRMPRRKVTGAAHKETIKSPKALNDGMVVVKRALTDLKLDPKTGEISNYYMPQSDRLLYEALKEALKKHGGDAAKAFAAPFHKPKSDGTPGPVVNKIKLCEPTTLNVAVLNGAGVADNDSMVRIDVFHVENDGYYFVPIYIADTLKKELPNKACTRGKPYAEWKEMDAEDFLFSLYPNDLIRVTSQKGLTLSKAQKESTLPDTYETKQEMLYYTSASINTAAVACRTHDNSYEIKSMGIKTLEKLEKFTVDVLGEYHKVEKEPRMAFCRK

SEQ ID NO: 11673 - protein, 1087 aa, synthetic construct
MYPYAIGFDIGIASVGWAVVALDGEDRPFGIINMGSRVFDAAEQPKTGDSLAAPRREARSARRRLRRHQHRLERIRRLLAAEKVVSQAELDTLFEGKLEDIYALRVEALDAPVSNTGFARILLHIAQRRGFKSNRKSGTSKEDGELLAAVTANRALMSEKGYRTVGEMLLKDPQYSGNKRNKGGKYLTTVGRDMVEEEVRAIFKAQREQGQPFAAAELEEQYLEILLSQRSFDEGPGQGSPYGGSQIEKMIGKCTLETGEPRAAKASYSFEYFTLLQNVNHLRLMSGGESSPLSSAQRETLIALAHKTKDLNFSRIRKELGIPAGTTFNAVFYKNAEDYEEAEKKTKFCYLRAYHQMRAAFNKLAKNHFDGLSRQQKNELGRVLSTYKTSANIRPRLAAAGLSEIEIDIAETMSFSKFGHLSVKACDKLIPFLEKGMKYDKACAAAGYDFKGHDGETRTRLLHPAEDDFADVTSPVVRRAISQTVKVLNAIIRERGGSPTFINIELAREMARDFAERSKMKKDMDENRARNERIMERIRTEYGRERPTGQDLVKFKLWEEQHGECAYSQRHISIERLFEPGYVEVDHIIPYSISFDDGYKNKVLVFTEENRNKSNRLPLQYLQGKRREDFTVWVESIILDFRKKQRLLKETITAEDEKKFKERNLQDTKTMSRFLLNYISDHLEFADFASGRKKHVTAVNGAVTSYMRKRWGITKIRENGDLHHAVDALVVACTTDGMIQQVSRYAALRECEYVQTEAGSMAVSQHTGEVLRQFPYPWPEFRRELEARLGDDPRRAVISQRFPVYANGDIPVRKLFVSRMPRRKVTGAAHKETIKSPKALDSGNVVVKRALTDLKLDPKTGEIANYYMPQSDRLLYEALKEELKKHGGNGAKAFTAPFHKPKSDGTPGPVVNKVKLCEPTTLNVPVLKGAGVADNDSMVRIDVFHVENDGYYFVPIYIADTLKKELPNKVCVAYKPYEQWKEMADKDFIFSLYPNDLLRVTHKTKLKLTKAQKESTLPDTYETKQEMLYYISANIHTAAIGCRNHDNTYEIGGMGIKTLEKLEKFTVDVLGEYHKVEKEPRMAFCRK

SEQ ID NO: 11674 - protein, 1087 aa, synthetic construct
MYPYAIGFDIGITSVGWAVVALDGEDKPFGIINMGSRIFDAAEQPKTGASLAAPRREARSMRRRLRRHRHRLERIRHLLVAENVISQAELDALFEGKLEDIYTLRVKALDTAVSHADFARILLHIAQRRGFKSNRKSGASKEDGELLAAVSANRALMVEKGYRTLGEMLLKDPQYSGSKRNKGGKYLATVGRDMVEEEVRAIFKAQREQGQAFAAAELEEQYLEILLSQRSFDEGPGEGSPYRGSQIEKMIGKCTLEAGEPRAAKASYSFEYFTLLQNINHLRLICGGESRPLSDAQREFLIALAHKTKDLNFSRIRKELDIPADTTFNAVSYKSADGYEDAEKKAKFCYLRAYHQMKAAFNKLSKGHFDSLARQQKNELGRVLSTYKTSANIRPRLAAAGLSEMEIDIAETMSFSKFGHISVKACDKLIPFLEKGLKYNDACAAAGYDFKGHDSETRTRLLHPTEDDFADVTSPVVRRAISQTAKVLNAIIRERGNSPTFINIEMAREMARDFTERSKMKKDMDENRARNERIMERIRTEYGKEHPTGQDLVKFKLWEEQHGECAYSQKHLSLEHLFDPDYAEVDHIIPYSISFDDGYKNKVLVLAEENRNKGNRLPLQYLQGERRDDFIVWVENSIHDYRKKQRLLKETITAEDEKGFKERNLQDTKTMSRFLLNYISDHLEFSDFSTGRKKHVTAVNGAITSYLRKRWGIAKIRENGDLHHAVDALVVVCTTDGMIQQLSRYSTLRECEYVQTEAGSIAVSMHTGEVLKRFPYPWPEFRRELEARLGDDPCRAVISQRFPVYANGDIPVRKLFVSRMPRRKVTGAAHKETIKSPKALNDGVVVVKRALTSLKLDPKTGEISNYYMPQSDRLLYEALKEALKKHGGNAAKAFAAPFHKPKSDGTPGPVVNKIKLCEPTTLNVAVLNGAGVADNDSMVRIDVFRVENDGYYFVPIYIADTLKAELPNKACTRGKPYAEWKEMDAEDFLFSLYPNDLIRVTSQKGLTLSKAQKESTLPDTHETKQEMLYYISANIHTAAIGCRAHDNSYEIKSMGIKTLEKLEKFTVDVLGEYHKVEKEPRMAFCRK

SEQ ID NO: 11675 - protein, 1087 aa, synthetic construct
MIPYAIGFDIGITSVGWAVVALDSEDKPYGIINMGSRIFDAAEQPKTGASLAAPRREARSMRRRLRRHRHRLERIRHLLVIENVISQAELDTLFQGKLEDIYTLRVRALDTAVSNTDFARTLLHIAQRRGFRSNRKSETAKEDGELLAAVSKNRALMVEKGYRTVGEMLLQDPLYAASKRNKGGQYIATVGRDMVAEEVRAIFRAQRQLGQPFASEELESRYLDILLSQRSFDEGPGEGSPYAGSQIERMIGKCTLEPEEPRAAKASYSFEYFTLLQNINHLRLIRGGESCPLSDAQRESLIALAHRTKDLNFSRIRKELDIPADTIFNAVSYKNADAYEEAEKKTKFCYLKAYHQMKAAFNKLSKDHFDSLTRQQKNELGRVLSTYRTSANIRPALAEAGLSEPEIDIAETMSFSKFGHISVKACDKLIPFLEKGLKYNDACAAAGYDFKAYGGEVRTHLLHPTEDDFSEITSPVVRRAISQTVKVLNAIIRERGCSPTFINIELAREMARDFAERSKMKKDMDENRARNEKIMERIRTEYGKENPTGQDLVKFKLWEEQHGECAYSQKHLSIEHLFDPDYAEVDHIIPYSISFDDGYKNKVLVLAEENRNKGNRLPLQYLQGKRREDFIVWVKNSIHDSRKTQRLLKESITSEDEKKFRERNLQDTKTMSRFLLNYISDHLEFSAFATGRKKHVTAVNGAITSYMRKRWGIAKIRENGDLHHAVDALVVACTTDGMIQQLSRYSALRECEYVQTETGSVAVSMHTGEVLKRFPYPWPEFRRELEARLGDDPCRAVISQRFPVYINGDIPVRKLFVSRMPRRKVTGAAHKETIKSPKALHEGIVVVKRALTDLKLDPKTGEIANYYMPQSDRLLYEALKEKLKKHGGDGAKAFAAPFHKPKSDGMPGPVVNKVKVCEPTTLNVPVLKGAGVADNDSMVRIDVFHVENDGYYFVPIYIADTLKAELPCKACVAYKPFEQWKEMSDENFIFSLYPNDLLRVTHKTKLKLTKAQKESTLPDTYETKQEMLYYIGADIHTAAISCRNHDNSYGIRGMGIKTLERLEKFTVDVLGEYHKVEKEPRMAFCRK

SEQ ID NO: 11676 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENVISQAELDTLFAGKLEDIYTLRVKALDAPVSHTEFARILLHIAQRRGFRSNRKAETAKEDGELLAAVSKNRALMVEKGYRTVGEMLLQDPLYAASKRNKGGQYIATVGRDMVAEEVHAIFRAQRQLGQPFASEKLEARYLGILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKRFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKEQLMKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKASTLPDTYETKQELLYYISAGISVAAISCRTHDAAYEIKSMGIKTLEKLEKFTVDVLGEYHKVEREPRMTFNRK

SEQ ID NO: 11677 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENMISQAELDTLFAGKLEDIYTLRVKALDAPVSRTEFARILLHIAQRRGFRSNRKAETAKEDGELLAAVSKNRALMAEKGYRTVGEMLLQDPLYAASKRNKGGQYIATVGRDMVAEEVRAIFRAQRQLGQPFASEELESRYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTILKLDKNGEIANYYMPQSDRLLYEALKEQLMKYGGEGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQELLYYISANINTAAIACRTHDAAYEIKSMGIKTLEKLEKFTVDVLGEYHKVEREPRMAFNRK

SEQ ID NO: 11678 - protein, 1086 aa, synthetic construct
MIPYAIGFDIGITSVGWAVVALDSEDKPYGIINMGSRVFDAAEQPKTGASLAAPRREARSARRRLRRHQHRLERIHRLLLTENVISQAELDTLFAGKLEDIYTLRVKALDAPVSRTEFARILLHIAQRRGFRSNRKAETAKEDGELLAAVSKNRALMAEKGYRTVGEMLLQDPLYAASKRNKGGQYIATVGRDMVAEEVHAIFRAQRQLGQPFASEELESRYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYNFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKAMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKRFPYPWPEFRRELEARLGDDPRRAVISQRFPVYLNNDIPVRKFFVSRMPRRKVTGAAHKETIKSPKALQDGVVVTKRPLTSLKLDKNGEIANYYMPQSDRLLYEALKEQLMKYGGEGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDESFIFSLYPNDLMRVTHKNKLKLTKAQKESTLPDTYETKQEMLYYISAGISVAAISCRTHDAAYEIKSMGIKTLEKLEKFTVDVLGEYHKVEREPRMTFNRK

SEQ ID NO: 11679 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENVISQAELDTLFAGKLEDIYTLRVKALDAPVSHTEFARILLHIAQRRGFRSNRKAETAKEDGELLAAVSKNRALMVEKGYRTVGEMLLQDPLYAASKRNKGGQYIATVGRDMVAEEVHAIFRAQRQLGQPFASEKLEARYLGILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKEQLMKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQEMLYYISTNINTAAISCRTHDAAYEIKSMGIKTLEKLEKFTVDVLGEYHKVEREPRMAFNRK

SEQ ID NO: 11680 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENVISQAELDTLFAGKLEDIYTLRVKALDAPVSRTEFARILLHIAQRRGFRSNRKSETAKEDGELLAAVSKNRALMVEKGYRTVGEMLLQDPLYAASKRNKGGQYIATVGRDMVAEEVRAIFRAQRQLGQPFASEELESRYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKEQLMKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQELLYYISAGISVAAISCRTHDAAYEIKSMGIKTLEKLEKFTVDVLGEYHKVEREPRMAFNRK

SEQ ID NO: 11681 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENVISQAELDTLFAGKLEDIYTLRVKALDAPVSRTEFARILLHIAQRRGFRSNRKAETAKEDGELLAAVSKNRALMVEKGYRTVGEMLLQDPLYAASKRNKGGQYIATVGRDMVAEEVRAIFRAQRQLGQPFASEKLEARYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNADDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNNIPVRKLFVSRMPRRKVTGAAHKETIKSPKALQDGVVVTKRPLTSLKLDKNGEIANYYMPQSDRLLYEALKEQLMKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQEMLYYISAGIAVAAISCRTHDAAYEIKSMGIKTLEKLEKFTVDVLGEYHKVEREPRMAFNRK

SEQ ID NO: 11682 - protein, 1086 aa, synthetic construct
MIPYAIGFDIGITSVGWAVVALDSEDKPYGIINMGSRVFDAAEQPKTGASLAAPRREARSARRRLRRHQHRLERIHRLLLTENVISQAELDTLFAGKLEDIYTLRVKALDAPVSRTEFARILLHIAQRRGFRSNRKSETAKEDGELLAAVSKNRALMVEKGYRTVGEMLLQDPLYAASKRNKGGQYIATVGRDMVAEEVRAIFRAQRQLGQPFASEKLEARYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNADDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKAQLMKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQELLYYISAGISVAAISCRTHDAAYEIKSMGIKTLEKLEKFTVDVLGEYHKVEREPRMTFNRK

SEQ ID NO: 11683 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENMISQAELDTLFAGKLEDIYTLRVKALDAPVSRTEFARILLHIAQRRGFRSNRKAETAKEDGELLAAVSKNRALMAEKGYRTVGEMLLQDPLYAASKRNKGGQYIATVGRDMVAEEVRAIFRAQRQLGQPFASEELESRYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKAKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNNIPVRKLFVSRMPRRKVTGAAHKETIKSPKALQDGVVVTKRPLTSLKLDKNGEIANYYMPQSDRLLYEALKEQLMKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQEMLYYISAGIAVATISCRTHDAAYEIKSMGIKTLEKLEKFTVDVLGEYHKVEREPRMAFNRK

SEQ ID NO: 11684 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENVISQAELDTLFAGKLEDIYTLRVKALDAPVSHTEFARILLHIAQRRGFRSNRKAETAKEDGELLAAVSKNRALMVEKGYRTVGEMLLQDPLYAASKRNKGGQYIATVGRDMVAEEVHAIFRAQRQLGQPFASEKLESRYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKKHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKEQLMKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQELLYYISTNINTAAISCRTHDAAYEIKSMGIKTLEKLEKFTVDVLGEYHKVEREPRMAFNRK

SEQ ID NO: 11685 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENMISQAELDTLFAGKLEDIYTLRVKALDAPVSRTEFARILLHIAQRRGFRSNRKAETAKEDGELLAAVSKNRALMVEKGYRTVGEMLLQDPLYAASKRNKGGQYIATVGRDMVAEEVHAIFRAQRQLGQPFASEKLEARYLDILLSQRSFDEGPGEGSPYAGSQIERMIGKCTLEDGEQRAAKATYSFEYFTLLQNINHLRLLRGGEGSPLTPAQRETLIALAHKTKELNFSHIRRELAIPADTTFNAVYYKNADDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTICSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKAQLIKYGGDGAKAFTQPFHKPKSDGTPGPIVNKVKLCEPTTLHVPVLKGTGVTDNDSMVRIDVFYVEGEGYYFVPIYIADTLKKELPSKACVAFKPYEDWKAMSDENFIFSLYPNDLMRVTHKNKLKLTKAQKESTLPDTYETKQELLYYISANINTAAIACRTHDAAYEIKSMGIKTLEKLEKFTVDVLGEYHKVEREPRMAFNRK

SEQ ID NO: 11686 - protein, 1090 aa, synthetic construct
MLPYAIGLDIGISSVGWAVVGLNDNERPYGIINMGSRIFDAAEQPKTGDSLAAPRREARSARRRLRRHKHRNTRIRQLLVNSNVVSHEKLESLFDGQLEDIYTLRVRALDNAVSSDEFARILLHISQRRGFRSNRKNGNSKEDGELLKMVNRNQALMAEKNYRTVAEMFLNDESYKQAKRNKGGQYTATVSRDMVENEVHQIFEAQRRFGMAFASENMETAYLEILLSQRSFDEGPGGNSPYGGSQIERMVGKCTLEPDEPRAAKAEYSFEYFNLLERINHIRIVDGGQANPLTQEQRLTVIELAHKPEKLTYASLRKHLGIPDGQTFNMVHYRSDKTVEEAEKAENFCYLKAYHQMRRAFDKLSKGYIDQLSVAQRNAIGRVLSLYKTSARIQSELAAAGLDEAEITIAESIGSFSKFGHLSVKACDKLIPYLEQGMNYNDACTAAGYDFKGHSGTEKSKLLHLKPEDLEDVTSPVVRRAVSQTVKVLNAIIRERGCSPTYINIELAREMARNFSERKKMDKQMQENRANNERLLEKIRHEYGKENPTGLDLVKLKLFEEQGGVCAYSLKQMSITQLFDSDYAEVDHIIPYSISFDDSYKNKVLVLTKENRDKGNRLPMQYLTGKRRDDFVVWVNSCVRSDKKKRQLLKEHITEEDEKKFKERNLQDTKTMSRFLLNYINDNLEFAPSKRRKKRVTAVNGAVTSRLRSRWGITKIRENGDLHHAVDALVIACTTDGMIQNISRYSAWQERKYSPVDDGSVAVDPDTGEVLQHFPYPWPCFRKELEARLGSNPLQAVTSQRFPIYMGRDFPIRPLFVSRMPRRKVTGAAHKETIKSPVALDNGYVVVKKPLADLKLDKDGEIANYYEQAKQDDRLLYEALKAQLKLYGGDGKKAFTQPFRKPKSDGTPGPIVNKVKLCEPTTLNVPVHQGKGVADNDSMVRIDVFKVEGDGYYFVPIYVADTLKPELPNKACVAHKAYDEWKEMQEEDFIFSLYPNDLMKVTHKKALKLTKSQKESTLPDSYETKSELLYYMGANISTGAITCRTHDSSYEISGVGIKTLENLEKYTVDVLGAYHKVEKETRQPFHRKRG

SEQ ID NO: 11687 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENMISQAELDTLFAGKLEDIYTLRVKALDAPVSRTEFARILLHIAQRRGFRSNRKAETAKEDGELLAAVSKNRALMAEKGYRTVGEMLLQDPLYAASKRNKGGQYIATVGRDMVAEEVRAIFRAQRQLGQPFASEELESRYLDILLSQRSFDEGPGEGSPYAGSQIERMIGKCTLEDGEQRAAKATYSFEYFTLLQNVNHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFIERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMVRFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNNIPVRKLFVSRMPRRKVTGAAHKETIKSPKALQDGVVVTKRPLTSLKLDKNGEIANYYMPQSDRLLYEALKEQLMKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQEMLYYISAGIAVAAISCRTHDAAYEIKSMGIKTLEKLEKFTVDVLGEYHKVEREPRMAFNRK

SEQ ID NO: 11688 - protein, 791 aa, synthetic construct
AQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLNFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFAERNQAKKSMDDNRARNERLMERIRTEYGKEHPTGQDLVKLKLWEEQHGECAYSQRHISIEHLFEPDYAEVDHIIPYSISFDDGYKNKVLVLAEENRNKGNRLPLQYLQGKRREDFIVWVENTIRSTPKKQRLLKEKFTFEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGRSLAVSVHTGEVLKSFPYPWPEFRRELEARLGDDPRRAVISQRFPVYLNNDIPVRKLFVSRMPRRKVTGAAHKETIKSPKALQNGVVVTKRPLTSLKLDKNGEIANYYMPQSDRLLYEALKEQLVKYGGDGAKAFTQPFHKPKSNGTPGPIVNKVKLCEPTTLHVPVLKGTGVADNDSMVRIDVFYVEGEGYYFVPIYIADTLKKELPSKACVAFKSYEDWKAMSDENFIFSLYPNDLMRVTHKNKLKLTKAQKESTLPDTYETKQELLYYVSANINTAAIACRTHDAAYEIKSMGIKTLEKLEKFTVDVLGNYHKVEREPRMAFNRK

SEQ ID NO: 11689 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENMISQAELDTLFAGKLEDIYTLRVKALDAPVSRTEFARILLHIAQRRGFRSNRKAETAKEDGELLAAVSKNRALMVEKGYRTVGEMLLQDPLYAASKRNKGGQYIATVGRDMVAEEVHAIFRAQRQLGQPFASEKLEARYLDILLSQRSFDEGPGEGSPYAGSQIERMIGKCTLEDGEQRAAKATYSFEYFTLLQNINHLRLLRGGEGSPLTPAQRETLIALAHKTKELNFSHIRRELAIPADTTFNAVYYKNADDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTICSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKAQLIKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQELLYYISANINTAAIACRTHDAAYEIKSMGIKTLEKLEKFTVDVLGEYHKVEGEPRMAFNRK

SEQ ID NO: 11690 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENVISQAELDTLFAGKLEDIYTLRVKALDAPVSRTEFARILLHIAQRRGFRSNRKAETAKEDGELLAAVSKNRALMVEKGYRTVGEMLLQDPLYAASKRNKGGQYIATVGRDMVAEEVHAIFRAQRQLGQPFASEKLEARYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKAMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKAQLIKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEVWKAMSDENFIFSLYPNDLMRVTHKNKLKLTKAQKESTLPDTYETKQEMLYYISTNINTAAISCRTHDAAYEIKSMGIKTLEKLEKFTVDVLGEYHKVEREPRMAFNRK

SEQ ID NO: 11691 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENMISQAELDTLFAGKLEDIYTLRVKALDAPVSHTEFARILLHIAQRRGFRSNRKSETVKEDGELLAAVSKNRALMVEKGYRTVGEMLLQDPLYAASKRNKGGQYIATVGRDMVAEEVRAIFRAQRQLGQPFASEKLEARYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDETQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKEQLMKYGGDGAKAFTQPFHKPKSDGTPGPIVNKVKLCEPTTLHVPVLKGTGVADNDSMVRIDVFYVEGEGYYFVPIYIADTLKKELPSKACTRGKPYVEWKEMETKDFQFSLYPNDLMRVTHKNKLKLTKAQKESTLPDTYETKQELLYYISAGISVAAISCRTHDAAYEIKSMGIKTLEKLEKFTVDVLGEYHKVEREPRMAFNRK

SEQ ID NO: 11692 - protein, 1086 aa, synthetic construct
MIPYAIGFDIGITSVGWAVVALDSEDKPYGIINMGSRVFDAAEQPKTGASLAAPRREARCARRRLRRHQHRLERIRRLLLTENVISQAELDTLFAGKLEDIYTLRVKALDAPVSHTEFARILLHIAQRRGFRSNRKSETVKEDGELLAAVSKNRALMVEKGYRTVGEMLLQDPLYAASKRNKGGQYIATVGRDMVAEEVRAIFRAQRQLGQPFASEELESRYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNADDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKAMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKEQLMKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQELLYYISAGISVAAISCRTHDAAYEIKSMGIKTLEKLEKFTVDVLGEYHKVEREPRMAFNRK

SEQ ID NO: 11693 - protein, 1086 aa, synthetic construct
MSPYAIGFDIGITSVGWAVVALDSEDKPYGIINMGSRVFDAAEQPKTGASLAAPRREARSARRRLRRHQHRLERIRRLLLTENVISQAELDTLFAGKLEDIYTLRVKALDAPVSHTEFARILLHIAQRRGFRSNRKAETAKEDGELLAAVSKNRALMAEKGYRTVGEMLLQDPLYAASKRNKGGQYIATVGRDMVAEEVRAIFRAQRQLGQPFASEKLESRYLDILLSQRSFDEGPGEGSPYAGSQIERMIGKCTLEDGEQRAAKAAYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTAAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERECSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSMPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGAVVTKRPLTSLKLDKNGEIANYYMPQSDRLLYEALKEQLMKYGGDGAKAFTQPFHKPKSDGTPGPIVNKVKLCEPTTLYVPVLKGTGVADNDSMVRIDVFYVEGEGYYFVPIYIADTLKKELPGKACVAFKPYEDWKAMSDENFIFSLYPNDLMRVTHKNKLKLTKAQKESTLPDTYETKQELLYYIGADISTASVAGRTHDNSYMTRGVGIKTLEKLEKFTVDVLGEYHKVEREPRMAFNRK

SEQ ID NO: 11694 - protein, 1084 aa, synthetic construct
MYPYAIGFDIGITSAGWAVVALDGEDKPFGIINMGSRIFDAPKTGASLAAPRREARSMRRRLRRHRHRLERIRHLLVAENVISQAELDALFEGKLEDIYTLRVKALDTAVSHADFARILLHIAQRRGFKSNRKSGTSKEDGELLAAVSANRALMAEKGYRTVGEMLLKDPQYSGSKRNKGGKYLATVGRDMVEEEVRAIFKAQREQGQSFAATELEEQYLEILLSQRSFDEGPGEGSPYRGSQIEKMIGKCTLEAGEPRAAKASYSFEYFTLLQNINHLRLICGGESRPLSDAQREFLIALAHKTKDLNFSRIRKELDIPADTTFNAVSYKSADGYEDAEKKAKFCYLKAYHQMKAAFNKLSKGHFDSLARQQKNELGRVLSTYKTSANIRPRLATAGLSEMEIDIAETMSFSKFGHISVKACDKLIPFLEKGLKYNDACAAAGYDFKGYDSETRTRLLHPTEDDFADVTSPVVRRAISQTVKVLNAIIRERGNSPTFINIELAREMARDFTERSKMKKDMDENHARNERIMERIRTEYGKEHPTGQDLVKFKLWEEQHGECAYSQKHLSLKHLFDPDYAEVDHIIPYSISFDDGYKNKVLVLAEENRNKGNRLPLQYLQGKRRDDFIVWVENSIHDYRKKQRLLKETITAEDEKGFKERNLQDTKTMSRFLLNYISDHLEFSDFSTGRKKHVTAVNGAITSYLRKRWGIAKIRENGDLHHAVDALVVVCTTDGMIQQLSRYSTLRECEYVQTEAGSIAVSMHTGEVLKRFPYPWPEFRRELEARLGDDPRRAVISQRFPVYANGDIPVRKLFVSRMPRRKVTGAAHKETIKSPKALNDGIVVVKRALTDLKLDPKTGEISNYYMPQSDRLLYEALKEALKKHGGDAAKAFAAPFHKPKSDGTPGPVVNKIKLCEPTTLNVAVLNGAGVADNDSMVRIDVFHAENDGYYFVPIYIADTLKKELPNKACVAYKPYEQWKEMSDDNFIFSLYPNDLLRVTHKTKLKLTKAQKESTLPDTYETKQEMLYYISANIHTAAIGCRNHDNTYEIGGMGIKTLEKLEKFTVDVLGEYHKVEKEPRMAFCRK

SEQ ID NO: 11695 - protein, 1086 aa, synthetic construct
MIPYAIGFDIGITSVGWAVVALDSEDKPYGIINMGSRVFDAAEQPKTGASLAAPRREARSARRRLRRHQHRLERIRRLLLTENVISQAELDTLFAGKLEDIYTLRVKALDAPVLHTEFARILLHIAQRRGFRSNRKAETAKEDGELLAAVSKNRALMVEKGYRTVGEMLLQDPLYAASKRNKGGQYIATVGRDMVAEEVRAIFRTQRQLGQPFASEELESRYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREVAQDFTERNQAKKSMDDNRARNERLMERIRAEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKAQLMKYGGDGAKAFTQPFHKPKSDGTPGPIVNKVKLCEPTTLHVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQELLYYISANINTAAIACRTHDAAYEIKSMGIKTLEKLEKFTVDVLGEYHKVEREPRMAFNRK

SEQ ID NO: 11696 - protein, 1086 aa, synthetic construct
MIPYAIGFDIGITSVGWAVVALDSEDKPYGIINMGSRVFDAAEQPKTGASLAAPRREARSARRRLRRHQHRLERIRLLLLTENMISQAELDTLFAGKLEDIYTLRVKALDAPVSHTEFARILLHIAQRRGFRSNRKAETAKEDGELLAAVSKNRALMAEKGYRTVGEMLLQDPLYAASKRNKGGQYIATVGRDMVVEEVRAIFRAQRQLGQPFASEKLESRYLDILLSQRSFDEGPGEGSPYAGSQIERMIGKCTLEDGEQRAAKAAYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDETCAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFTDFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDQLLYEALKEQLIKHGGDGAKAFTQPFHKPKSDGTPGPIVNKVKLCEPTTLYVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQEMLYYISAGIAVAAISCRTHDAAYEIKSMGIKTLEKLEKFTVDVLGEYHKVEREPRMAFNRK

SEQ ID NO: 11697 - protein, 1086 aa, synthetic construct
MIPYAIGFDIGITSVGWAVVALDSEDKPYGIINMGSRVFDAAEQPKTGASLAAPRREARSARRRLRRHQHRLERIRLLLLTENIISQAELDTLFAGKLEDIYTLRVKALDAPVSHTEFARILLHIAQRRGFRSNRKAETAKEDGELLAAVSKNRALMAKKGYRTVGEMLLQDPLYAASKRNKGGQYIATVGRDMVVEEVRAIFRAQRQLGQPFASEKLESRYLDILLSQRSFDEGPGEGSPYAGSQIERMIGKCTLEDGEQRAAKAAYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRGRTQLLHPTPDDLADITSPVVRRAVAQTVKVLNAIIRDRGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDQLLYEALKEQLMKHGGDGAKAFTQPFHKPKSDGTPGPIVNKVKLCEPTTLYVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQELLYYIGADISTASVAGRTHDNSYMTRGVGIKTLEKLEKFTVDVLGEYHKVEREPRMAFSRK

SEQ ID NO: 11698 - protein, 1086 aa, synthetic construct
MIPYAIGFDIGITSVGWAVVALDSEDKPYGIINMGSRVFDAAEQPKTGASLAAPRREARSARRRLRRHQHRLERIRLLLLTENMISQAELDTLFAGKLEDIYTLRVKALDAPVSHTEFARILLHIAQRRGFRSNRKAETAKEDGELLAAVSKNRALMAEKGYRTVGEMLLQDPLYAASKRNKGGQYIATVERDMVVEEVRAIFRAQRQLGQPFASEKLESRYLDILLSQRSFDEGPGEGSPYAGSQIERMIGKCTLEDGEQRAAKAAYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRGRTQLLHPTPDDLADITSPVVRRAVAQTVKVLNAIIRDRGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDEKQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDQLLYEALKEQLMKHGGDGAKAFTQPFHKPKSDGTPGPIVNKVKLCEPTTLYVPVLKGTGVADNDSMVRIDVFYVEGEGYYFVPIYIADTLKKELPSKACVAFKPYEDWKAMSDENFIFSLYPNDLMRVTHKNKLKLTKAQKESTLPDTYETKQELLYYIGADISTASVAGRTHDNSYMTRGVGIKTLEKLEKFTVDVLGEYHKVEREPRMAFSRK

SEQ ID NO: 11699 - protein, 1027 aa, synthetic construct
MRRRLRRHRHRLERIRHLLVAENVISQAELDTLFEGRLEDIYALRVRALDAAVSNTDFARILLHIAQRRGFKSNRRSGTSKEDGELLAAVNNNRALMAEKGYRTVGELLLKDPQYRDNKRNKSGKYIATVGRDMAEEEARAIFKAQRELGQAFAAEALEAQYLEILLSQRSFDEGPGEGSPYAGSQIERMIGKCTLEPEEPRAAKACYSFEYFTLLQNINHLRLIRGGESSPLSDAQRDALIALAHKTKDLNFSRIRKELDIPADTIFNTVSYKNADAYEETEKKTKFCYLKAYHQMKAAFNKLSKNHFDTLTRQQKNELGRVLSTYKTSANIRPRLAEAGLSEPEIDIAETMSFSKFGHISAKACDKLIPFLEKGMKYNDACAAAGYDFKAHGGEPLTRLLHPAEDDFSDITSPVVRRAISQTAKVLNAIIRERGCSPTFINIELAREMARDFAERSKMKKDMDANRARNEKIMERIRTEYGKETPTGQDLVKFKLWEEQHGECAYSQKHLSIEHLFDPDYAEVDHIVPYSISFDDSYMNKVLVLAEENRNKGNRLPLQYLQGRRREDFIVWVENSIHDPRKKRRLLKETITSEDEKKFRERNLQDTKTMSRFLLNYISDHLEFSAFATGRKKHVTAVNGTITSYMRKRWGITKIRENGDLHHAVDALVVACTTDGMIQQLSRYSALRECAYVQTETGSVAVSMHTGEVLKHFPYPWPEFRRELEARLGDDPRRAVISQRFPVYVNGDIPVRKLFVSRMPRRKVTGAAHKETVKSPKALNDGIVVVKRALTDLKLDPKTGEISNYYMPQSDRLLYEALKEELKKHGGDGSKAFAAPFHKPKSDGTPGPVVNKVKVCEPTTLNVPVLGGAGVADNDSMVRIDVFHVENDGYFFVPIYIADTLKAELPNKACVAHKPFEQWKEMSDENFVFSLYPNDLLRATHKTRLKLAKAQEDSTLPDTYETKQEMLYYISADIAAASITCRNHDNSYRIRGMGIKTLEKLEKFTVDVLGEYHKVEKEPRMAFSRK

SEQ ID NO: 11700 - protein, 1074 aa, synthetic construct
MIPYAIGFDIGITSVGWAVVALDSEDKPYGIINMGSRVFDAAEQPKTGASLAAPRREARSARRRLRRHQHRLERIRRLLLTENMISQAELDTLFAGKLEDIYTLRVKALDAPVSHTEFARILLHIAQRRGFRSNRKSETVKEDGELLAAVSKNRALMVEKGYRTVGEMLLQDPLYAASKRNKGGQYIATVGRDMVAEEVRAIFRAQRQLGQPFASEKLEARYLDILLSQRSFDEGPGEGSPYAGSQIERMIGKCTLEDGEQRAAKATYSFEYFTLLQNINHLRLLRGGEGSPLTPAQREALIALAHKTKELNFSHIRRELAIPADTTFNAVYYKNTDDAEEAEKKTKFSYLKAYHQMRTAFNKLSKNHFDTLTRAQKNELGRVLSTYKTSAKIRAALLPAGLSDAELDIAETLSFSKFGHISVKACDKLIPFLEKGMKYDEACAAAGYDFKAHSGRERTQLLHPTPDDLADITSPVVRRAVAQTVKVLNAIIRERGCSPTFINLELAREMAQDFTERNQAKKSMDDNRARNERLMERIRTEYGKEHPTGQDLVKLKLWEEQHGECAYSQKHISIEHLFEPDYAEVDHIIPYSISFDDGYKNKILVLAEENRNKGNRLPLQYLQGKRREDFIVWVENTIRSTPKKQRLLKEKLTSEDETQFKERNLQDTKTMARFLLNYIGDHLAFADFAAGRKKHITAVNGAVTSYMRKRWGISKIRENGDLHHAVDALVIACTTDGMIQQVSRYAALRECEYVQTEGGSLAVSVHTGEVLKSFPYPWPEFRRELEARLGDDPRRAVISQRFPVYLNNDIPVRKLFVSRMPRRKVTGAAHKETIKSPKALQDGVVVTKRPLTSLKLDKNGEIANYYMPQSDRLLYEALKEQLMKYGGDGAKAFTQPFHKPKSDGTPGPIVNKVKLCEPTTLHVPVLKGTGVADNDSMVRIDVFYVEGEGYYFVPIYIADTLKKELPSKACTRGKPYVEWKEMETKDFQFSLYPNDLMRVTHKNKLKLTKAQKESTLPDTYETKQELLYYISAGISVAAISCRTHDAAYEIKAWASRPLKSWRNSPWMCWASTTR

SEQ ID NO: 11701 - protein, 1172 aa, synthetic construct
WISANGVSHEINIGAGTLARPIEEVCATLLHEMVHYSNYQLDKVVNRRALTPRFCGASSLFVAFFSLTHYNYSILCQGGILMYPYAIGLDIGITSVGWAALALDEKENPFTILGMGSRIFDAAEQPKTGASLAAPRREARSARRRLRRHRHRNERIRALFLSSGLLSEAELATLFEGKLEDVYLLRVVALDKPVTRSEFARILIHLSQRRGFRSNRKSVVDNKDGKLLEAVSENKRRMQEAGYRTAGEMMLRDPAFFNSKRNKGGNYLSTVTRDMTADEIHEIFTAQRSFGSEFAGEDFENAYLEILLSQRSFDDGPGGNSPYSGSQIEKMVGVCQFETNEPRAAKATYSFEYFNLLQRINQIRIISGGESRVLMAEQRNQLIELAHKTENLDYSKIRKVLLIPPTEIFNTVRYSGEQSSEEVEKKEKFCYLRAYHQIRKALDKVEKGRIAYLPRTQINSIGTALSLYKTSTKIRERLQKDGLETCDIDAVELLGSFSKFGHLSVKACDKIIPFLEQGMNYSEACTAAGYAFKGHENEKTSVFLHPTNDDFTDITSPVVRRAVSQTIKVVNAIIREQGCSPTYVNIELAREMAKDFAERKKLEKDMKENQARNERMMERIRTEYGQTCATGQDLVKLKLYEEQGGVCMYSQKQMSLEHLFDLDYAEVDHIIPYSISFDDSYKNKVLVLTKENRDKRNRLPLEYLTGKRRDQFVVWVNNTVHDKRKRQLLLKESLTEEDQAKFKVRNLQDTKTMSRFLLNYINDNLEFATSTRGRKKRVTAVNGSVTAYMRKRWGITKVREDGDLHHAVDAVVIACTTDGMIQEVSRYAALRECEYTQADGKSIAKDPLTGKQLRTFPYPWHDFRRELEARLSKDPVRVITDYKLPAYLDGDRIDSVKPLFVSRMPQRKVTGAAHKDTVKSSKALDDGFAVVKKPLTDLKLDKHGEIADYYMRQSDRLLYEALKARLIEFDGDGSKSFAEPFCKPKHDGTQGPVVNKVKLCEKTTLNVAVQDGAAIAENDTMVRVDVFYVGGDGYYLVPIYVADTLKSELPNRACIAHKPYSEWQEMSAENFVFSLFSNDLICVTHRKKIRLTKVFKDSTLPKTLELKSEFLYYKGFNISSGAVTCINHDNTYTIDGLGIKTLEKLEKYTVDVLGNLHQIKEEKRQPFCIGRS

SEQ ID NO: 11702 - protein, 1086 aa, synthetic construct
MYPYGIGLDIGITSVGWSVVALDGQERPCGILNMGTRIFDAAEHPKTGDSLAAPRREARSARRRLRRHKHRNERIRQLLLARKIVTDDELVHLFDGHLEDIYTLRVRALDEVISSMEFARILLHISQRRGFRSNRKNDASTEEGELLSRVQHNRTVMLEKGYRTVAELYLKDAAYHDHKRNKGGNYTATVGRDMIEDEVHQIFEAQRRFGATFAAEDVESAYLEILLSQRSFDEGPGGNSPYSGSQIEKMVGRCTFEPEEPRAAKASYSFEYFNLLEKINHIRVLENGHSIPLTSEQRQCLVALAHKTADLTYAKIRKELSLTETQTFNMVHYMDGAPLETAEKKEKFCYLKAYHQMRKAFDKVSKGYFDHLTVLQRNEIGRVLSLYKTEENIRKNLSAIGLSMEDIEIAESIGTFSRFGHLSVKACEKIIPFLEKGMTYSDACTAAGYQFKGHDDAKKDRLLHLAPEVLENVTSPVVRRAVSQTVKVMNAIIRERGYAPTYVNIELAREMSKDFAERKKIEKENKENQARNERLLERIRNEFGKSDPTGLDLVKLKLYEEQGGVCAYSLKQMSLEHLFDADYAEVDHIIPYSISFDDSYKNKVLVLTKENRNKGNRLPLQYLTGKQREDFIVWANACVRNSRKRQNLLKERISEEDEKKFKERNLQDTKTISRFLLNFINDTLEFAPSSRRKKRVTAVNGAVTSHLRRRWGITKIRENGDLHHAVDALVIACTTDGMIQQISKYTMWRECRYTPLEEASIAVDEATGEVISKFPYPWPDFRKELEARLSSDPRATTRQLSFYVNNPEAVVRPLFVSRAPKRKISGAAHKETIKSPVAIGAGLVVAKHSLTDLKLDKDGEIANYYMPHSDRLLYEALKVQLKRFGGDGKKAFTEPFHKPKSDGTPGPVVNKVKLCEPSTLNVSVHNGMGVADNDSMIRIDVFHVENDGYYFVPIYVADTLKPELPCKACVAHKPYSGWKAMRNEDFIFSLYPNDLIKIVHKSGINMALKNKDSTLLSQVTVKEQMFYYTAANISSGAIALKTHDGAYEAHLGIKTLEKVEKFTVDVLGEYHKIDKETRQPFKRKRG

SEQ ID NO: 11703 - protein, 1086 aa, synthetic construct
MYPYGIGLDIGITSVGWSVVALDGQERPCGILNMGTRIFDAAEHPKTGDSLAAPRREARSARRRLRRHKHRNERIRQLLLARKIVTDDELVHLFDGHLEDIYTLRVRALDEVISSMEFARILLHISQRRGFRSNRKNDASTEEGELLSRVQHNRTVMLEKGYRTVAELYLKDAAYHDHKRNKGGNYTATVGRDMIEDEVHQIFEAQRRFGATFAAEDVESAYLEILLSQRSFDEGPGGNSPYSGSQIEKMVGRCTFEPEEPRAAKASYSFEYFNLLEKINHIRVLENGHSIPLTSEQRQCLVALAHKTADLTYAKIRKELSLTETQTFNMVHYMDGAPLETAEKKEKFCYLKAYHQMRKAFDKVSKGYFDHLTVLQRNEIGRVLSLYKTEENIRKNLSAIGLSMEDIEIAESIGTFSRFGHLSVKACEKIIPFLEKGMTYSDACTAAGYQFKGHDDAKKDRLLHLAPEVLENVTSPVVRRAVSQTVKVMNAIIRERGYAPTYVNIELAREMSKDFAERKKIEKENKENQARNERLLERIRNEFGKSDPTGLDLVKLKLYEEQGGVCAYSLKQMSLEHLFDADYTEVDHIIPYSISFDDSYKNKVLVLTKENRNKGNRLPLQYLTGKQREDFIVWANACVRNSRKRQNLLKERISEEDEKKFKERNLQDTKTISRFLLNFINDTLEFAPSSRRKKRVTAVNGAVTSHLRRRWGITKIRENGDLHHAVDALVIACTTDGMIQQISKYTMWRECRYTPLEEASIAVDEATGEVISKFPYPWPDFRKELEARLSSDPRATTRQLSFYVNNPEAVVRPLFVSRAPKRKISGAAHKETIKSPVAIGAGLVVAKHSLTDLKLNKDGEIANYYMPHSDRLLYEALKVQLKRFGGDGKKAFTEPFHKPKSDGTPGPVVNKVKLCEPSTLNVSVHNGMGVADNDSMIRIDVFHVENDGYYFVPIYVADTLKPELPCKACVAHKPYSGWKAMRNEDFIFSLYPNDLIKIVHKSGINMTLKNKDSTLLSQVTVKEQMFYYTAANISSGAIALKTHDGAYEAHLGIKTLEKVEKFTVDVLGEYHKIDKETRQPFKRKRG

SEQ ID NO: 11704 - protein, 1086 aa, synthetic construct
MYPYGIGLDIGITSVGWSVVALDGQERPCGILNMGTRIFDAAEHPKTGDSLAAPRREARSARRRLRRHKHRNERIRQLLLARKIVTDDELVHLFDGHLEDIYTLRVRALDEVISSMEFARILLHISQRRGFRSNRKNDASTEEGELLSRVQHNRTVMLEKGYRTVAELYLKDAAYHDHKRNKGGNYTATVGRDMIEDEVHQIFEAQRRFGATFAAEDVESAYLEILLSQRSFDEGPGGNSPYSGSQIEKMVGRCTFEPEEPRAAKASYSFEYFNLLEKINHIRVLENGHSIPLTSEQRQCLVALAHKTADLTYAKIRKELSLTETQTFNMVHYMDGAPLETAEKKEKFCYLKAYHQMRKAFDKVSKGYFDHLTVLQRNEIGRVLSLYKTEENIRKNLSAIGLSMEDIEIAESIGTFSRFGHLSVKACEKIIPFLEKGMTYSDACTAAGYQFKGHDDAKKDRLLHLAPEVLENVTSPVVRRAVSQTVKVMNAIIRERGYAPTYVNIELAREMSKDFAERKKIEKENKENQARNERLLERIRNEFGKSDPTGLDLVKLKLYEEQGGVCAYSLKQMSLEHLFDADYTEVDHIIPYSISFDDSYKNKVLVLTKENRNKGNRLPLQYLTGKQREDFIVWANACVRNSRKRQNLLKERISEEDEKKFKERNLQDTKTISRFLLNFINDTLEFAPSSRRKKRVTAVNGAVTSHLRRRWGITKIRENGDLHHAVDALVIACTTDGMIQQISKYTMWRECRYTPLEEASIAVDEATGEVISKFPYPWPDFRKELEARLSSDPRATTRQLSFYVNNPEAVVRPLFVSRAPKRKISGAAHKETIKSPVAIGAGLVVAKHSLTDLKLNKDGEIANYYMPHSDRLLYEALKVQLKRFGGDGKKAFTEPFHKPKSDGTPGPVVNKVKLCEPSTLNVSVHNGMGVADNDSMIRIDVFHVENDGYYFVPIYVADTLKPELPCKACVAHKPYSGWKAMRNEDFIFSLYPNDLIKIVHKSGINMALKNKDSTLLSQVTVKEQMFYYTAANISSGAIALKTHDGAYEAHLGIKTLEKVEKFTVDVLGEYHKIDKETRQPFKRKRG

SEQ ID NO: 11705 - protein, 1086 aa, synthetic construct
MYPYGIGLDIGITSVGWSVVALDGQERPCGILNMGTRIFDAAEHPKTGDSLAAPRREARSARRRLRRHKHRNERIRQLLLARKIVTDDELVHLFDGHLEDIYTLRVRALDEVISSMEFARILLHISQRRGFRSNRKNDASTEEGELLSRVQHNRTVMLEKGYRTVAELYLKDAAYHDHKRNKGGNYTATVGRDMIEDEVHQIFEAQRRFGATFAAEDVESAYLEILLSQRSFDEGPGGNSPYSGSQIEKMVGRCTFEPEEPRAAKASYSFEYFNLLEKINHIRVLENGHSIPLTSEQRQCLVALAHKTADLTYAKIRKELSLTETQTFNMVHYMDGAPLETAEKKEKFCYLKAYHQMRKAFDKVSKGYFDHLTVLQRNEIGRVLSLYKTEENIRKNLSAIGLSMEDIEIAESIGTFSRFGHLSVKACEKIIPFLEKGMTYSDACTAAGYQFKGHDDAKKDRLLHLAPEVLENVTSPVVRRAVSQTVKVMNAIIRERGYAPTYVNIELAREMSKDFAERKKIEKENKENQARNERLLERIRNEFGKSDPTGLDLVKLKLYEEQGGVCAYSLKQMSLEHLFDADYTEVDHIIPYSISFDDSYKNKVLVLTKENRNKGNRLPLQYLTGKQREDFIVWANACVRNSRKRQNLLKERISEEDEKKFKERNLQDTKTISRFLLNFINDTLEFAPSSRRKKRVTAVNGAVTSHLRRRWGITKIRENGDLHHAVDALVIACTTDGMIQQISKYTMWRECRYTPLEEASIAVDEATGEVISKFPYPWPDFRKELEARLSSDPRATTRQLSFYVNNPEAVVRPLFVSRAPKRKISGAAHKETIKSPVAIGAGLVVAKHSLTDLKLDKDGEIANYYMPHSDRLLYEALKVQLKRFGGDGKKAFTEPFHKPKSDGTPGPVVNKVKLCEPSTLNVSVHNGMGVADNDSMIRIDVFHVENDGYYFVPIYVADTLKPELPCKACVAHKPYSGWKAMRNEDFIFSLYPNDLIKIVHKSGINMALKNKDSTLLSQITVKEQMFYYTAANISSGAIALKTHDGAYEAHLGIKTLEKVEKFTVDVLGEYHKIDKETRQPFKRKRG

SEQ ID NO: 11706 - protein, 1092 aa, synthetic construct
MLSYGIGLDIGIASVGWATVALDAEDRPYGIIGMGSRVFNAAEDPDNGASLAAPRREARSQRRRLRRHKHRNQRIRALLVREGLLSEAQLAHLFEGKLPDIYALRVRALDEAVSGPELARILIHLAQRRGFRSNRKSADPKEEGDLLSAVSANRARMAQGGYRTAAEMYCKDELFREHRRNKDGNYLATIGRDMVEEEARQIFEAQRQHGNPAASEALESAYLEILLSQRAFDEGPGENSPYAGNQTENMVGACSILKGELRAAKASYSFELFTLLQTINHIRIVTRGQSQALTPEQRNRVRDLAHKVKNLDYARLRKELGLDETQTFNTVNYGRDDSVAKAEKSKKLGCLTAYHQMREAYERIAKGHFSDISVAQRNAIAETLSRHSTSTYIRPPLRDAGLSELDIDVAETLNFSKHGHISVKACEMLIPFLEQGMNYSEACAAAGHPLPTPEQAQDGVEKTPFLPTLDQDARQSVTSPVALRAISQTIKVVNAIIRERGCSPTFLHVELAREMVKDFKERDQIKKEYEQNQKRNERIMERLRTEFKRSSPTGQDLVKLRLYEEQGGICPYSQDPIVLARLFEPGYAEVDHIVPYSISFDDGYRNKVLVLAKENRQKGNRLPLQYLSGQRREAFTVWVKNAVRDPRKRQRLLKEAITEEDEARFKDRNLKDTQTASRFILNYIQNHLLFAPYSGGKSKHVQAVNGSVTSYLRKRWEMKKVRADGDLHHAVDALVVACTTDGMIQRVSRYAQFRETRYMRPEAGGGCPDTEDDARSRAFPLPWPRFREELAARLSSDPVRAVRGLGLPLYLTQEVPLRPIFVSRAPRRKVSGQAHKATIRSGKDLEHGKLVGKVALTNLKLVDGEIKGYYRKEDDRLLYEALRARLIQFDGNAKKAFAEPFHKPKHDGTPGPLVKKVQICKTSTLNVPIPGSNGFAENGDMVRIDFYHVEGDGYYFVPIYVPDTLKAVLPNKACVKRKKAEDWKPMRDADFLFSVYPNDLLRITHKKMLKLKCTQKESTLAPSYETKSALLYFTSANINTAAISCCNHDNSYCIESLGIKTLESIEKYSVDVLGVCHPVQREKRLDFSGKKR

SEQ ID NO: 11707 - protein, 1091 aa, synthetic construct
MTPYAIGLDIGISSIGWAEIALAEDDTPRGILNLGSRIFDAAEQPKTGESLAAPRREARSARRRLRRHRHRAERIRQLIVKEALLSEQELAALFDGQLSDIYALRVKALDELVTRAEFARILIHISQRRGFRSNRKQPSDKEEGKLLEAISQNRSRMKESGYRTVAEMMLKDPVFAEHKRNKGGNYLSTVTREMVEEEVELIFHSQAAFGASFATKRMKEQYLEILLSQRSFDDGPGGNSPYGGNQIEKMVGKCEFEPTLSRAAKATYSFEYFNLLQNTNHIRISTAGENRALTPAERRIVVELAHKTENLDYAKLRKALQLTAEDRFSRVRYEQEKSPEECEKKEKFQYLKAYHQIRKALDKIAKGHVRDLSRDQLNSIGTALTLYKTEAKIRAYLKGAGLDDFDIDAIVDIGSFSRFGHLSTVACDKIIPYLERGMTYSDAATAAGYHFRGHAGSERTRYLQISEDDIADITSPVVRRAISQTVKVVNAIIRERDCSPVFINIELAREMSKDFNERNKIRKENEENHARNDKLMEMIREEFGKRNATGQDLLKQKLFNEQGGVCAYSLKQMSQEHLFDPGYAEIDHIIPYSLSFDDSMHNKVLVFTGENRNKGNRLPLEYLTGKQRDDFIVWTKTQVRDYRKRQKLLKEHFTEEDSAAFKERNLQDTKHISRFMMNYLADNLEFAPSGQGRKKRVTAVNGALTSYLRKRWGITKIRENGDLHHAIDAVVIACATDSMIQQISRHASLRECGYVQGNAESFAVDEKTGEVLRRFPYPWPDFKRELEARTASDPVRIIRDCKLPFYWEDDRLSTVKPIFVSRMAHRKVTGAAHLETVKSDRLLDDGFVIAKRPLTDLKLKNGEIENYYAPESDRLLYDALRDRLVRFNGNAAKAFAEPFYKPKHDGSPGPLVKKVKIAEKSTLQVPVYEGKGVAANDSMVRIDVFFHEGDGYYFVPIYVADTLKPTLPNKACVAGKPYQEWKEVQDGDFIFSLYPGDLIKATHRSTMKLTKLQPESSLPETVEARSFLLYFKKASISTASITCITHDSAYGISSLGIKTLDHLEKYFVDILGTCHAVKKEKRQTFANMKRS

SEQ ID NO: 11708 - protein, 711 aa, synthetic construct
MGIRIGVDVGEKSLGLAAIDYDDDGWPIRILAAVSHIHDGGMDPETAKSPQSRLATAGVARRTRRLIRNRRRRLQALDEMLRKHGFDVPSEEIPQTYEAWDARDRLSREFVTDDEERNRLLVLALRHLARHRGWRNPWSSYARLEQEPTPSAALTAILDKAKERYGEVAIDEAATLGQVVAGVARSRDSIRLTKAAKSAEQDPVILTQVKQEDSLAEAKLILQTQRVPETTIDEICRVLMFQNKPKIPKDRIGACALIPGEVRASLATLEFQEYRVRSTVANLKIGKAKQPLTPEQHDLVCEWLLAWRESDRPKWREVADLLGIPPRELPIPSVDDAHFAMAPVQRTYMTLESVFNAKSEIGSWWRSASQQDQGEFIAGIADLSGDDGELESANVAALMTSLTDKSREALDKLQLETGRAAYSREALRRLNEVMRADHCDAHTARKKAFDLDDNWKPPQPSFSDHIEHPTVARINILIRRFLTTAVEQWGMPERIVVEHVRGAFMGPSALAELKSEIRFNTARREKTRADLRIQGISEPRDADIRRNECVQRQNSQCLYCGTSIGLTTSELDHVVPRAAGGGNRRDNLVAVCKPCNAAKGKLPFAVFADQSQNPEITVEAAKTRVRSWQKLPGVTPRQLSTLKTDVQYRLGLVADDDDFGDRSIESTAYAAREMRARIQSFVLERGGDPNSVWVFGEPSPAKPGKLVASTA

SEQ ID NO: 11709 - protein, 1096 aa, synthetic construct
MKYRIGIDVGEKSVGFAAVEYDDNGAPIKILSAVSHIHDGGMDPETAKSPLSRIATAGVARRARRLVRNRRRRLQRLDVLLNDLGFVLPQAEVPQTHDAWVVRSKLSREFEPNEQVRNHELLLAIRHIARHRGWRNPWWTWRRLEEAPVPSENFAAMLVDANERFGSRVAGCATLGQLVHSIASSGAPIRRTKKTEGTGNSPLMSRQIMQEDSLSELRLILATQKLSSEDSDKICAEVFSQEKPHIPEGRIGRCSLDPNELRAPLAALEFQEFRIRAVVANLRLGRSGTKLSDEQHDLVVNFLTNWSSSDRPRWADVAELLGVTSRELRQPSIDSEGGGAAPCNRTVLTIEKHFKEKSAVRQWWKTASQNDRSEFVAIVTDLTGVDVEPSSESLAEFMTTWDETIQESIDKLDLESGRAAYSRATLSKLNAVMRESRCDVHTARKVAFGVADDWQPPKPTFNDPIEHPTVGRVNVLVRRYLSTASQKWGAPESVIIEHVRGAFMGPTALRELENEIKNNTRRRDEIKTRIVAQGVENPTNTDVMRHELIERQNGTCLYCGTSIGMKSCELDHIIPRATGGGNRRDNLVAVCRECNGEKDKLPFVEFAKSCTRPGVSLEEALSRVRNWEKGRMTFDQSKRLKRDVSKRLAMSADEVEEVRSIESTAYAAREMRQRVESFLGITSSSVPDETESRVFVFQGLITSEARKAGGVDDQLRLRSFTRKSRFDRRHHAIDAAVITTLDASVARILKDRAEMQSVQRMTGHEPGWKDFKGRTPEQQKRFAIWESQIGELANLLVSAIAKDKVAVVRPLRLVPRVGSVHKDTVSKLISKPINDEFTEDELLRIVNARVLEKLLPLANVKGGLDASADRKSQLGLKTDEIQLFAERAAAIPVRGGSAEIGSTVQHARVYAWKTPKGFSYGMVRMFTGEFARIGFLKAGIDIFSEPMPVTSQAMLRADSTLRKKIESGEAKQIGWITVGDEIEINVEAHKNAGGNLGEFLKVISDERWTITGFFTTKQISIAPRLLASEGIDEEGTPQLIKQVLFANRIPMSINVIFGQSNFAVIRRSILGTVRWTGAGAPVSWVPEVEARKAFGE

SEQ ID NO: 11710 - protein, 1106 aa, synthetic construct
MDSVRYTIGIDVGERSVGCAAIEFDDDGFAAKALALVSNIHDGGEDPASGQSKVSRLASAGVARRTRRLHLRRRKRIERLSELLAANGYVTTTDGDTYDAWHARDELSCSFIEDAEERNSMIATAALHIARHRGWRNPWHGYDRLASSDFPSANLANTLARATDWANVDEGALDTLGQAVSAVLDTRGTKATIRPRGGADEPLMQEQVLASDQLHELRQILETQRLPEDLIDQICRTTFHSEKPHVPTSRIGHDVMPGMKAYPRATRATLEFQEFRIRAFVGNLRLKEAGSKRRLTAEEYDAVVSSLMSWRASDNPKVADIADVLDVKPSAINRDLLDADSLAVPIDRTTRDIEAMLPKRHALRTWWDGASEQARAEWVAAIVDVSDSADVDDDVLSEPLAIMSDDDDAPQLVEKVVDALQSGRTSYSRESLTRLIAHMRETRCDEFVARCEVFDLPEDWREPLPTLDDPIEHPALQRVNTIVRRFIEGCHAKWGQPERVVIEHVRGAFLGPATLQEFRIETKRNQTRNSNRRKDLETAGVANPSMRDVRRHLSLQRQNSTCLYCGGTIDMTTCQMDHIVPDSLGGANTRENLVAVCRTCNALKGKVSFVEFAATTNRPGVSLEEAVARVRTWQRIDESSVQLRRLKTDVSRRLRMTAADIEDADERSMATTAYAALEMRRRIAGSLEIELARVDVYRGGITREARRAGGVDAMLRVRGEDDKSRFDRRHHAIDAAVITTLYPLTSRTLAERSSMRTAEGLEDDPNKKWREYDGRTKNAREDFELWRQRVGSVADVIKKSLDADRIVVTRPLRLTPSSGRAHLDGIHRLAHKSLMDEWSAAEIDRITDPDIYSAMLGLIGSKTTLAADDARRSLLSSDAGTKGVVSLFPGGGAQTLVRGGAADLGEVHHARVYAWQTKQGFGFGWIRVFAGELRPLGIANGDVLAAALPMHSASMRTANRGLRTRIENGSAIQIGWLTSDDEIELNPLTERLQSGKIGNFLSSIPERRWLIQNFDQPDKVGIAPALLAREGLPQRFTAEAEGGSLSAAAVVNIINKPGVVLAVNVLLQDPTLTVIRRTSLGRPRWNSDSLPVSWSPWKAAERAFKR

SEQ ID NO: 11711 - protein, 493 aa, synthetic construct
  source 1..493: note = MG71-2 effector
MFDNLDASKVNDFNAVFSEVENYVRDEMGIEDWSCQNIDELAKVLCDVNLGRTTKQKAMQSLLPAQTKQQKAIIQLFSGGKAKLAELFVDEELDECEKKSVSFQDDDLNEFEPVLTAALGERYEGLLRFKAIYDWSLLAKILHLDTSKKDEDEQHLLSECKMQVYEDHKRDLAVLKSMLKGKPLYNKIFRQDGDISYEKYAKGIKGRNQIDFCKDLKKQLEGIAEYKKIMQEITSIDDAKTEEERLLFRITNGFAFPKQTTKDNGIIPIQVHLAELKCILDNAEGYLPFLGETDNNGLSVREKIEQIVKFRIPYYVGPLAGTRMSREQGRCWVVRKNEKIYPWNFTEIVNLEESAEKFITNMTAKCTYLVGEDVLPKESLLYSEFMVRNAINNITVDGERLPVDVLEKIFKQLFLAKTSKVTKKTLERFFRQENISFQNIGGIDDKINASMKSYNDFRRIFGEDYIQLHRDEIENIIRWITLFCDEKKCWSLK

SEQ ID NO: 11712 - protein, 1027 aa, synthetic construct
  source 1..1027: note = MG73-1 effector
MTKILGLDLGIASVGYAVVNLDEQKFDGGEILTAGVRIFEAAENPKDGASLSAPRREARALRRILRRKTIRLQQIRNLFIKYQILTTEELNHLYASPLPSVWEIRTLSLYEKQPLQHIARALLHIAKRRGFRSMRKSAEEKNYETGQLLQGISLLQNLLKQSGRQTIGEFLYHLPQSEPKRNKAGSYNHSIARSMLEEEVRLILEKQRTYGNTALSSEFEQEFRAIAFDQQPLKPSSPGKCTFLPDEDRAPKQAYTAELFAALSKINHIRIVSQGTSRALSADERQIALDLCLEKENNNFAQLRKLLELQENEFFNISYIIPRAKQNTDYQPEKKTAVYKMTGYHALRKALKDHKPLWTTYMDNPNGGLDQIAVVLATFKSDKEIINALEKLQFPSELIEAVKSLSFSGFMHLSLKAMRNINPFLLEGHTYDKACELAGYNFQAAKRNAGLTKLPPLTEEENFSITSPVVKRSIAQTRKVVNALNRKYGPFDAVHIELAREMGRNWAQRKELTQQQKENQEERDLIKAQGIEGLFPKNSLDIKKIRLWKEQGGYCIYSNQYIKPEQILEEGYCQVDHIIPYSRSFDNTLSNQVLCLTKENQDKRNDIPFDYFQRIQRDWDSFVTLVNASPTMRPNKKQKLLRTELSEEDLAGFKDRNLNDTRFISSFVRKYLLQNLQLTNKYKQGVFCRNGKITADLRNMWGLSKIREQDDKHHALDAIVLACCSNAMMQQISTQYTHNKETAALKIKPLFPWPWKEFRTDVENALLSIFVSRPPRKKITGAFHKETYYSAKHLARGFKTLKTDINTLTAEKLAKQRDLEIKYYGVERNKKLYDAIEQALLARTDAKQPLKVYLGPAQTPVKKIKLIMEGNKGVPVLKGTAVAENGAMPRVDVFYKNGTYFLVPVYTIDFTKEKLPLISIPDNQPMDVRDFRFSLYKDDYVQIKNKTGETFEGYFKQYNAQTGQIYLETHDRSDSYTVSGKPASEKKFSKSTFVDFTKYQIDILGNQHRVEKEKYTGITRKNKGFGG

SEQ ID NO: 11713 - protein, 1129 aa, synthetic construct
  source 1..1129: note = MG89-2 effectors
MSYVLGLDLGIASVGWSIVEPGNRIIDLGVRVFKKAETDKEGDPLNLIRRESRLSRRRLYRRAHRLSRLLNFLISSGLIHSKDEVLKNVYNENPWALRTLGLNSVLTNNQLARVIYHICKHRGFYWASSADDGQADNGKIKKSLSSNQLVMKEKGYKTVGQMIFTEYPNCQRNKSGEYSKSLPRTDLDKELRAIFKAQQSFSNPIVTKDFINAIVGCGDRKTGFLWEQRPALQGEDLLKMVGHCRFEKDELRAPAANFYSEQLVWLTKINNLRVYDEDSQERPLTREERDLILNMPLEMKSDIKYSSLTSAFEKANLWKSGQFKYKSVDYEQKTQKKKNTAKSVDITKSSKKNPEDKVFYKSSHLHEIRKALGSSLSEEWEKIRTEVLSGKYDRYNRIAYVLTVYKEDSDVIEQLSPYESRTLIEALLPVRFSGFVALSEKSLKKIIPHMVLGKRYDEACSEANYKHYKQNQAEFKKLKYLPPLFSGREPNGTLIFNEEIGDIPRNPVVLRVINQTRKVVNAIVKKYGSPKSVHIELARDLAKSRAERNEIEKRNEEAASRHIKERDEFEKLFGSKCLNGTNLLKYRLYKEQDCKSMYSSKEIDHKRLFEKGYVQIDHILPYSRSYDDSQSNKVLVLTNENQDKGNRIPFEYFEAKQHGFSWYEFEQWVKSCKNLNQKKKRNLLRCSLSKDAKKDFLERNLNDTRYACRFVKNYIDSFLCLSENSDNSGCVVVAGQLTAYLRNCWGLNKVREENDRHHALDATVIACCTRKIVQKVGAWSKSREMNSYNSSYVDPDSPVDEDEKLLQKLYVNTRKPDFPKPWECFRSEVESRVFESALEKLKEKLKLQCSYTESELKNVRTLFVSRACEKIGKGALHGDTVYRQTSEMRKENVAVKKVSLKKLKYARIEAIVDADTRNKNLCDALKKRYEEYARKIGKKIEDFVDKDIAKIFADDNPLHMPNSDGQEDPCNPIVKSVRVKEAFSGVPIRNGVAGNSTIIRVDLFKKDGKYYCIPVYAWNKTLPNRAYVSGKKETDWALVDDSFEWCFSIRQNELLKIKLKGETIFGYYNGFDRDRGSFNILLHDRQDGKDHKQGLIRKGIKTAISITKYDVDVLGNYYLSKPEKRLELA

SEQ ID NO: 11714 - RNA, 119 nt, synthetic construct
  source 1..119: mol_type = other RNA; note = MG73-1 sgRNA
nnnnnnnnnnnnnnnnnnnnnnnngttatagtgggaaatcactataataagtgaaatcgcaaggctctgttcttgaacatcctttattataaaactcctgccaatcggttgggagtttt

SEQ ID NO: 11715 - RNA, 112 nt, synthetic construct
  source 1..112: mol_type = other RNA; note = MG89-2 sgRNA
nnnnnnnnnnnnnnnnnnnnnnnngttgtagcttccttgaagaaattcaacgttgttacaataaggttttcgaaagattaccgaacccgccctcacttaggtgagggctttt

SEQ ID NO: 11716 - protein, 1121 aa, synthetic construct; identical to SEQ ID NO: 8357
  source 1..1121: note = MG99-1 effector

SEQ ID NO: 11717 - RNA, 120 nt, synthetic construct
  source 1..120: mol_type = other RNA; note = MG14-241 sgRNA
nnnnnnnnnnnnnnnnnnnnnnnngtcttgccggaaacggctagacaagggaatcgcttttacgcgattacccgcaaggtaagcccgtcagcacccttggtgtcggcgggcgatcctttt

SEQ ID NO: 11718 - protein, 1154 aa, synthetic construct
  source 1..1154: note = MG16-1 effector
MIKNILGLDLGVGSIGWALIQTEDDQPKQIIGMGSRIVPLTKDDSDQFTKGQAISKNAERTARRTTRKGYDRYQLRRALLTQVLRQNGMLPECMDENMIDLWKLRSDAATEGKQLTLQQIGRVLYHINQKRGYKHAKSDDNGDSKQTKYVEAVNLRYKEIQEKNVTVGQHFYAELLNSKVESGNGPYYTFRIKDKVFPRAAYIAEFDQIMGVQKEYYPNVLTDELIETLRNRIIFYQRPLKSCKHLVGLCEFEMRPYKKDGKIVYGGPKCAPRTSPLAQLCAMWETVNNITLTNRNNERLEISNEQRRQLVQFLCTHETLKLTDLYKILGITKKDGWYGGKAIGKGIKGNVTLNQLRKALDGKYSQWLEMPIERIDVVDRNTAEAFWAVSPKVEETPLFQLWHAVYSLQNVEELTKTLQNRFSITDPQVIDALCKIDFVKPGYANKSHKFIRRLLPYLMEGMMYSEACACIQINHSNSMTKAEREARPLAERIELLQKNALRQPVIEKILNQMINLVNRLQQEYGPIDEARVELARELKQSREERKDAFDRNNKNEKRNKEISALISEQGIRPSRSRIQKYKMWEESEHRCMYCGKVVNLSEFLNGADVEIEHIIPRSILFDDSFSNKVCACRDCNREKDNMTAMDYMASKPEGEFEAYKQRVDEAFNAHRISKTKRDHLLWRRADIPQDFIDRQLRLSQYIATKAVEILQQGIRQVWTSGGGVTDFLRHQWGYDEILHTLNLPRYRQVEDLTEMVHYEHAGQEHDEERIKNWSKRIDHRHHAIDALTVALTRQSYIQRLNTLEASHEHMEKLVKEANTPYKEKKSLLEKWVALQPHFSVEEVTTQVDGILVSFRAGKRVTTPARRAVYHGGKRTIVQRGIQVPRGALTEDTIYGKLGDKFVVKYALDHPSMKPENIVDPTIRLLVENRITALGKKDAFKTPLYSAEGMEIKSVRCYTSLSEKGVVPIKYNEKGNAIGFAKKGNNHHVAIYKDQSGQYQEMVVSFWDAVERKLYGVPTVITNPKTVWDELLEKELPQDFLEKLPKDNWQYVLSMQENEMFVLGMEEDEFNDAIDTQDYNTLNKHLYRVQKLSHADYTFRFHTETKVDDKYDGVENGRNTSMSLKALVRIRSFNGLFTQFPHKVKIDIMGRITKA

SEQ ID NO: 11719 - RNA, 100 nt, synthetic construct
  source 1..100: mol_type = other RNA; note = MG16-1 sgRNA
nnnnnnnnnnnnnnnnnnnnnngttgtgtatggaaacatacacaataaggattattccgttgtgaaaacattcagggtgggacgcaagtctcgccctttt

SEQ ID NO: 11720 - protein, 1027 aa, synthetic construct; identical to SEQ ID NO: 11712
  source 1..1027: note = MG73-1 effector

SEQ ID NO: 11721 - protein, 1058 aa, synthetic construct
  source 1..1058: note = MG73-2 effector
MNKILGIDMGIASLGYAVVNIDDENFVNGDILASGVRIFDVAESPDGSSLAAPRRAARSVRRILRRKVMRIKAIKQLFLDFNLLSPQELDLLSKQDFKTLYQATPEGQPIPSVWEIRARALDNPCSLVDICRALLHIAKRRGFRSMRKSEKLTGEAGKLLKGVEEMQKKLQESNFRTIGELLFHLPATEPKRNKDGSYSHSVARSLLEEEVHLILQVQRAKGANALSQEFETQFCKIAFLQNPLQPSDPGFCTLEPTEPRAPKNAYTAELFAALCKINHIYLEEDGQSHALSAAQRALALEKCFSTQKTNYKQLRELFNLPNDIKFNISYTAPAKKKSKKKEEAQSPEQAVQAPQEYDAEKNTTLYNMAGFHALKKALKSSPLWAEYQTNPNGILDKIAEVLSRYKSDGEIRQHLTALGLPAEAVEKLQNVNFSGFMNLSLVAMNKIIPFLKEGFRYDVACKKAGYNFQAPQQNKGLSKLPPLTEEDNHTITSPVAKRSLAQARKVINALNKKYGPFDAVHIEVAREIGKSFEKRKEIEAEQKAHAEERARLKEVGIDGIIPQTETDLKKLRLWKEQDGRCMYSLQYIEPRKILEEGYCQVDHIIPYSLSFDNSLNNQVLCLTSENQHKKNQIPYEYFHSGKAQITWEDFEGYVNSLQNIRMAKKHRLLKQELTEDDLQGFKERNLSDTKLISRFMKNYLLANLRLTGKYKQGVFCVNGKHTSTLRGFWRLQKIREDGDKHHALDAIVIACCTNRLMQYISTKYRQNRELELQRKEVAVPWPFPHFKHAVENSLLSIFVSRPPRKKVTGALHKNTFFSAKHIKKGIKTLRTDIQKLTLDSLKKQRELEVKYFGVERNKPLYDLIETALNNRPNDKTPIQVQMPTKNGGFVPVRHIKLISESTSGIPVLGGTALAENDSMPRVDVFLEDGQYYVVPVYTMDFAKGVLPLVAQPSGRLMKKENFVFSLYKDDYVNLVNKQGETWEGYFKQLNAQTGQIYLESHDRSAQYTVSGKPSNQKKIASSTLKLIEKYQIDIFGGKHLVKKEKYIGIIRKNKGFGG

SEQ ID NO: 11722 - protein, 1098 aa, synthetic construct
  source 1..1098: note = MG74-1 effector
MQVHDDVILGLDIGVGSLGWALLEEDLQTGEQRLLQRQTPQGETTYALGVRLFHVPENAKTKELLNVKRRTARMQRRTTARRAQRMRRVRALLDSLGVPGVRDADAFHLGKGRGAQCDPWQLRREGLERRLEAREWAVVLLHIAKHRGFRSNSKTDRSGSDKEMGQVLQAVSNLQQEVEASGLTVGALLASRERRRNRADHTGAPRYDLCMLRSLQENEVDILFTRQRELGNPLAGEEVRCRYAELAFAQRPLAPVSHMVGPCAFLEGERRAPRFAPTAELFRYVQALCNMRLRQETGEETPLSEEQRQAACAVFGSVQSVTYKKLRQVLRLPAGCRFAGLSYGVTEKGNVQDPEKADVVMRTGKCCQGTACLRGILGDAYEALHEQRLDEADAARLAATGALSAPAAALLARGMAGLRLTDAVARIVSELNDLDQIRAVLALLPLAAPRIAALSQAAGEGKLGIFQGTARLSLRAMEAILPHMLACGEYAAACELAGFDPRAAQKTDVTDIRNPVVLRVFREVRRQFSAICREFGFLPGRVHVELLREVGKSGEERNRISRGLERRTKEKEAARKAVAQLLGKSPETVSAGEVQRYELWRQQDGKCAYYMLWRHAGGERAYGDAMPQGSIPPDWLADGVNAVQVDHILPRSRTFDNSFHNLCLCCHAANQAKGGRTPWEWLGAAQPQAWHDFEQWVQSLPLKGLKKRNYLLRDLNAEVQGRFHARNLTDSGYVARLTLRWLEEEYARHDVPMQDADGRTRRRFFARPGQVTDFLRRHWGVQALKKIDGQRSGDRHHALDALLVAACSEGMLQRMVRAFQREENGPERLHIPCPWQDFSATVGRALGSVFVSRVERGRTKGPLHEETLRAIREERQPDGETRRVLYERKAVARLTAADLDKIKDAARCPDVVAALRRWLDAGKPGDALPRSAHGDIIRHVRVCAGEFSSGVVLQRGSGQAQASNGGMVRTDIYSRDGKFYMVPVYAKDVADKRLPLRACVAAKAEKDWREMTADYRFLFSLTPDCYVLTENRKGEVKEGYFAGANRNTSAISLSLAHDKQNVIQGIGITTLKRFEKYRVDRFGRLSLVRREADPRGRS

SEQ ID NO: 11723 - protein, 1117 aa, synthetic construct
  source 1..1117: note = MG86-1 effector
MKKILSFDLGITSIGYSVLTEDEAQKYSLLDYGVSMFDKPTDKDGNSKKLLHAQALSTKKLYKLRKERKKNLALLFEKYALAKASKLLEQEKKNLYMYKWQLRAKKVFEERLSIGEIFTILYHIAKHRGYKSLDSGDLLEELCVELGIKIDVKKEKKDDEKGKIKQALSTIESLRKEYPKKTVAQIIYEVELQKERPVFRNHDNYNYMIRREHINDEIATIIRKQKEFGNFENIDSEVFIVDIIAAIDDQKESTNDMSLFGKCEYYPKEHVAHQYSLLSDIFKMYQAVANITFNKEKIKITKEQIRLLTEDFLNKIKKGKSVKELKYKDVRKILKLDESVKIFNKEDSYQRAGKKVEHTITKFHFVDNLSKIDKSFIEDIFNADESYVLMREIFDVIHKEKSPKRIYEQLKSKVSSEAVIIDLIRYKKGSSLNISSYAMAKFLPYFEEGMTLDAIKEKLDLGRKEDYSVYKKGIKYLHISTYEKDDDLEINNHPVKYVVSAVLRVVKHLHAKHGTFDEIKVESTRELSLNDKVKKEIDKANKAREKEIEKIISNDEYQKIAKEYGKNIHKYARKILMWEAQERFDVYSGKSIGIDDIFSNRVDVDHIVPQSLGGLYVQHNLVLVHRDENLQKSNQLPMNYITDKEAYINRVEHLFSEHKINWKKRKNLLASNLDEIYKDTFESKDLRATSYIEALTANILKRYYPFIDEKKSVDGSAVRHIQGRATANIRKVLGVKTKSRESNIHHGVDALLIGVTNPSWLQKLSNIFRENFGKIDDEARKNIKKALPYIDGVEVKDIVKEIEQKYNSYGEDSIFYKDIWGKAKTVNFWVSKKPMISKVHKDTIYADKGNGIFTVRESIIAKFINLKITPTTFPEDFMKKFHKEILEKMYLYKTNSNDVICKIVQQRAEEIKELLWSFEFLDVKNKEEMQEAKANLESLVHRELFDNNGNVVRKVKFYQTNLTGFKVRGGLATKEKTFIGFRAFKKDKKLEYKRIDVSNFEKIKKSNDGSFKVYKNDIVFFVFDEEKYKGGKIVSFLEDKKMAAFSNPKYPANIQAQPESFLTIFKGKANSHKQVSVGKAKGIIKLKVDILGNIESYQVLGNAKSKLLDEIKSIVSH

SEQ ID NO: 11724 - protein, 1122 aa, synthetic construct
  source 1..1122: note = MG86-2 effector
MKKILSLDLGITSIGYSVIEEFGNDRYSLIDYGVSMFDKATDKDGNSKKLLHSASTSTSKLYDLRKKRKKDLAQLFHNFGLGDKNSLLSQEKQNIYKNKWYLRCHKAFKEKLNINELFTIFYTLAKHRGYKSLDSSDLLEELCEKLNIPLETKTKKDDERGKIKKALKTIEELKQNSTKTVAQIIYEIELKKENPTFRNHDNYNYMIRREYIDQEIEKIIKTQKDFGLFDDKFDIDNFIEKLKDIITYQNPSTNDMRLFGNCEYYEDEKAAHQYSVISDIFKMYESVSNITFNTKPSIKITKEQINKIADDFFTKIKKGKNIADIKYKDIRKILALSDDTKIFNKDDSYISKGKKVEHTIIKFHFVNNLSKFDNSFIVENLNSLENLKEIFEVLQFEKDPTAIYEKLKDKIEDKQTIINLIKHKSGNSLNISAKAMVEFIPYFKDGLTTDKIKEKLELNRCEDYSKFYKGIKYLNIRQFEQDDNLDINNHPVKYVVSATLRVIKYLHIVCGTFDEIRVESTRELSQNEETKKAIEKANKELEKQINDIVQNKEYQNIAQHYGKNLQKYARKILLYEAQNRRDIYTGEGIEFEDIFTKKVDIDHIVPQSVGGLSVKHNLVLVFRDTNIQKSNQLPMNFVKDKQDFINRVEHLFSEHKINWKKRKNLLATNLDEIYKDTFESKSLRATSYIEALTAQILKRYYPFKDKEKQENGKAVSYIQGRATSNIRKILKVKTKTRDTNIHHAIDAILIGLTNQSWLQKLSNTFRENFGKIDEEARANIKKDMPIFEIIIDDEVKYLEPKELVELIEKNYNYDGENSIFYKDIWGKIKSVNFWVSKKPMVSKIHKDTIYSKKDDGIYTVRENIINHFINLKITPKTSSKKFEEEFNKKILNKMYLFKTNPKDAVCKAIIKRANDIKTLLDSFIDIDTKDKEAMNNAKTKLDELIHKDIPDNNGKPIRKIKFYQTNLTGFDVRGGLATKEKTFIGFKAQIINGKLNYTRIDVANIDKIKKENDNSFKVYKNDLVFFIYTDGTNKGGKIVSFLEDKRIAAFSNPRFPSSIGFQPHFFVTIFNGKANSHKQHSLNKAIGIIKLNLDILGNIKSYQKIGSCESELLEFIKKVIKD

SEQ ID NO: 11725 - protein, 1091 aa, synthetic construct
  source 1..1091: note = MG87-1 effector
MEKYIIGLDLGINNVGWSVVDAQTNKIKYLGVKQFEASDSAKDRRTQRNTRRRLKRRETRKTDILKILSNINFPNNLTIDTMLIETRCKGINEQISKQDITNILCYMATHRGYIPFGDEEVSFVDLDGKYPCEYYYEMFKSSTNNKYRALRNTVKNEENINEVKKMLETQRKYYPEITNETIENIVTTLQRKRKFWEGPGSINALTDYGRFKTPEDVVEYLDKKKENPEYEKYIFEDLIGKCSVIPNEKCVSQINFYAEKFNLLNDFINISFKSIEELNNKDDFYETQVKTYKLRESGLNKVFDYCMSKDTLTIKGLFKDLFATTIDNISGYRQDGHDPNKPEMSTMNTFRSIRKTFKECNANMDIFKPENTDLYNEIINYMMLVPGQVELINMLSTIMPLSENDKEALKKVFKSKKTNLKYHSLCEKILIRACNDMLSLQKNYMQVYKLKDYGKESRKEFVKRYEESNKGEKLMNPTFIDDIISSPQVKKTLRQSVKVINEIIKNEKSLPDVIVVESTKDTLNSEKMRKVYIDINKKQKALHDKAIKTLSSIGYSEKDISKKKIEKLMLYEEFDGLCPYCNNQITLKYLINGSDEIEHILPRSNSFDDSFDNRTVSCANCNKNKNNQTPLEFLKGNEKESFIERIKSNKNISEFKKENFLFAGDISKYRTRFFNRNLRDTAYATKEMINQINIFNLYLESKNKDERIKTLSTPGQITHSIRKRYDLEKDRDTDIPYHHAIDASILALLPTTKIGSKVVMFQNDNKFFLNENNKDKMTEIGLELKYYDTSEGKIEYDDYIADFKNINDTSNIFMYSPEVKKEPNKGLFNANMYKVIKIDDKYYKIDQINDIYNLSDSDKKLLPKLFDDAKNETLLCKLQHKEFYEKLKNIYIKYSDSKNSPFEDYQREINNLSKEDKFDYLKHGLKMSENAPSVKRLRYYTPISEPYLIDKKSINKKDGTYLAFDSLAQAGIEVYYNETKNCFAFVPIPSVCYNLKTRKVNRKHKLYKRYKELNLKDYKVKYIVTLYNGNTIEVLKKDNTIIKGVVSSYHKTNDKIVLKNGSYFTKSDLEFSIIDYNPIGKSQKRLTKRIK

SEQ ID NO: 11726 - protein, 1123 aa, synthetic construct
  source 1..1123: note = MG87-2 effector
MKKYTIGLDLGINNVGWAKYDLETKKVIDKGVVRFKESSTAQDRRIIRGSRRLRKRKQHRVERLAIQLSNINFCTSRSYEPELLNKRIKGLNESLSEQEITNIIYWFAIHRGYIPFDEEKPEREVHKFAEDEYPCQYIFDYYKEYGVYRGQCDLISLKDNLKELKQILLTQQKYHSKLTDEVIDNILYIIQSKREFWEGPGASKENQLSPYGRYRTLEDLEKYKADPTYHQYLYEMLIGKCELSIDKDGFMDQVAPKCNFYAEEFNFYNDFINMSVKEPSQIDEEYRNKITLKGKFTEDTIEEIKKEIISTKKVSLDKLVKKILGLELKDIQGYRIDKKYKPEISQFEFYKYLLKSFKDEKLNPSWLENDDKTIYNQIVYILTVAPSTYAIEDMLKDRVKEVEFKKEEIDVLIDIKKKKNPDLKYHSLSERILKKALDDIKRHNCEYNFMQIMKRLEYEKEMKEYFQNNYSTKTQSPYTIEDQYIDHLIANPQVKKTLRKAIKIINAIIKEEKNYPETIVIESATSLNSKERKKQIEEEQKTFNQLNKEVKKELEDNGYEATDKNMQLLINWKETNESCIYCGESISLKEVLITEIEHILPKSKSMDNSHNNTTCSCLKCNKEKNNRTPYQYLTSKNMYEGFKNRVMNQYDKMSQDKKSNLLFEGDIDKYSIKFINRNLRDTSYASVALVQELKKYNEYLGAKEGYKINIITSPGQLTSKIRQYLKIKDKDRTYLYHHVVDAMILASIPDTEIGKVLIEAQNDSQYWFKDKNKENKYKEEVYNMLNNVWLSNRDQIQKFNQDCDNMPDNNKEGLIKRSYEVLKNPVRQFSQYTEYAKYIKQNDVYYKISQIDNIYNLLIRKKDGSADKDKKLLDELFDLSNKKNKTLLCEKKDPKLYQKLKNIYEKNSFSINPFVDESKYMYGLEDGDKFDCLKQGIRKTDNSNSPLVIKLRYLEKVTNPYIKNNITTRRKNLYNEFTINKPKKDTLIGLDGLKQVSTRIFYSYEDKKFIFLPICAISFVNGKLNKKEKNYQTTYNRLIGNKNVKEMGNIYVGEWVGVYKKNGEYFEGRYKGYHKTSNVLEYYINGLDTLSCATIGSSDLRIIIYTTDILGNRHIRLDTQKEI

SEQ ID NO: 11727 - protein, 1085 aa, synthetic construct
  source 1..1085: note = MG87-3 effector
MTKNYSIGIDMGVNNIGWSILNNDTKKLENYGVRLFPTSNDAKERREVRNTRRRLKRKETRLDDTLYLLKKYGFNEDNTIEENLIEKRVKGLNEKLEKQDIVNILCYMIKHRGYIPFGDEEVTLVDLNGKYPCEFYYEMYKNGGKYRNRKMTVRITDNEKEIKKILETQSKYYKNINQDFINKYLNILTRKRKYWEGPGSINDLTPFGRFKTQEDVENYLEEKRKNPSYEKYIYEDLIKKCDYELEERCCCKLNIYYELFNMYQDFINVSFKNIEELENKDCFYETKNGLYKLNKKGLLMVKDYCMNNFKLKYTDILKKLFNTDKDNISGYRIDKDHKPEFSTLNSYRKIMLEFTEKGFDTTWVSDYNCYNEIMEKMTLTPGGVEFIKEIENNKLVPYKFNEEEKSLFKELKEYFNKKTLLSYGSLSQKILQKAINDMLDLEKNFMQVSRIKDYGKEARENFIKQYKKTSNKLEINASFVDDIIASPQVKKSLRQAIKIINAIIEKEGCLPVSIAIESTKELNSDKKKKEIEKEQKIQENLRKQASNYLSTVFGDSSVTETNILKVMLYNETNGHCAYCNKPLSINDIFADNIQVDHILPISKSFNDSFNNKIISCKKCNDDKKNNTPYQFLKNKNYFEEFEKRVLENKNISDYKKDNLLYKDDLDKYKTRFFNRNLRDTAYATTELINQIEIFNNYLEILDKKRINTLSVPGQITSSIRNRYVKNEDKTSLEKNRDAGVFHHAVDASIVVSVSDTHIGQIMLKAQNDKEYWIKNKSNYDDIYKYLINLRIDDTINQIEKINNENIKVSKQVSKNPQGKLANSNIYKMIKKDNEQYIINQIDNIYTFDFKKDENKKLFEKLLNEENNEFTLLCYDNDKNTFNYIKKIYNEYKNEKGNPFVNYLIDKGEIPDGNSFDYDITGIRMVTKKGNGPIIKRLRYYSKKNDLYILNKKNINKKDSNYLALDSLKQFCVKVYVDNDNKKFVFLPIYTISLDPKTKKVNENDEFYKLFYNKYIGNKNVTFFADIYNGNKLEITKKDGTIVSGYYSTFNKANNKLILNNGDTFTLSDKKISIIHTDILGNEKKG

SEQ ID NO: 11728 - protein, 1093 aa, synthetic construct
  source 1..1093: note = MG88-1 effector
MKYKIGLDLGSTSLGWAVVELNEADQITSLVDMGVRIFPDGRDAKSHKPINVIRREHRQMRRRGDRVLLRKKRVLQLIHKYGLDFDISADIKLEDPYVLRARAVSDKLSSAELGRVLFHLALRRGFKSNRKETRGDSGGKLKKATLALHDAIGDKTLGEFQVDSKRYRFADQFDGNKIKDGALYPTRDMYLDEFNRICSVQNMSDDMRQQFEYAIFHQRPLVPPEIGTCMFELDQPRAYKFEPVFQRFRVLQQINQLRIINNGEIKELTAEQREKLQDALLATFCGVKRDKSGRPKITFAEVKKLLGLSRNTKFNLESEKRKDMDVDATAFAFAECELADFWRACTDNVKSQVLAHLNDDELSDSDLVDYLAHEYGISQDKAEKLIQQPFEDGVANLSVCAMQKMLPFLEQGHLYHIAAKEAGYDHADRGIVHLDTLPYYGDVMALRPSLVQDKMGRYRTMNATVHIALNQLRAVVNDLIARFDGEPYAINIEMGRDVSAGADERAEIEKQQAANKRENDRIATELVAMGVRVCRENIQKYKLWENLGKSPLDRRCVYTGEIISKEKLFSPEFEIEHILPFSRTLDDSMANKTISAAVANRFKGNRSPDEAFSDPKSPWKYEDVVARAQNLPDATKWRFNRGAMDVFLQGKECIARAMNDTRFMTRMAVTYLQHVCADKNRVNGMPGRLTASLRDEWHLNWWKNKAEESKYRGNHIHHAIDAFVIACTDENILRKLADAKSDMHTPFPGFDYFDFKMRCENTIISYRQSQKNPKDAHSTVGCLHEDTAYNLECFEDGGCGVNAVMSHREELPTTDKDKKAFAKDFKNVNPKTLQMFLNDAGVANEEPDIAIKFLDWCAMRNIRKVRMYKTGVDVTTYVPVFRTKKQRDVYRAAYLNWYVNTGVASGIVDKKLRAVQQEKEKHLLQEFQDAAKQAYKWYVGGNNFCAEIFEIRDDDTRYPKLRGRWQVEILSNYNAQLNAGAPLWRHKYATAKRIMSLRINDMVMAEFSKDDPKLPKGLVETVAHQCAIEKTDKVNVVFRVKKLNSSGTVYLRPHFIAKEDADTKSWIASATSLQEHKARKVCVSPSGKILGLK

SEQ ID NO: 11729 - protein, 1146 aa, synthetic construct
  source 1..1146: note = MG88-2 effector
MNYRLGLDMGATSIGWSIYDVETEKLLDTGVRIFDDGREDKSKASLCVKRRNARGARKLNNRRHIKTQELLKILTTLGLFPQEQNKREDLKNDNPYKLRKEALDRQLSTYELGRTLMQLAKRKGFKSNRKDNREEGGKLKKGFAELKDIMQKENARTYGEFLYNCMQRNPDKPIRLKNTFDESGKYKGGLFPFREIYVNEFEQIWHKQKEYYPQILTDENKEKLKNIIFFQRPLKEAEEGECQFEKGEKRIPRAHPLFQEFRIWQNVLNLTFSAENEPDYKPLEKVQELIKLLMNPQEVKPNKQGIIIYANLKKALGLDKNGVFNFERQNNRDTDLEKGLLVNTTQNAINESEFLAPYWNNFSDAQKGELINVIMRPHNYIPFPKTRISIEEEDDLIINYVRKRFNLPQEAAEELLFDIDLEDDFGSLSEKAISKILPFMKQGTPYHDACQSAGYHHSYKEYEHIDKLPYYGEILGQSCLGKKNNPKCVEEEFGKINNATVHVALNQIRHLINEIIMRYGKPYDIAVEYARDLNASTQERLAMTDTRDKNELENQRIIKELQSKLGNHPYSKNDIQKYKIWKKLPFYDKNPLIRECPFSGEQIPLSELLNGQKFQIEHLIPFSRSLDDSLNNKVIATVEANRYKGNRTPFEAFGQSKDGYNWKDIQHRAKKLSVEQQWRFAPDAMQRFEKQEGPIVRSLIDTRYMTRLLQDYLQPIVKEDGKQRVQAVVGQLTSLVRKAWGLNVYKEKADKDKYREFHNHHAIDAIVISAINRAQIKDVVGILAHVRDDIREEYKDELFQLSDNNVPEDKKREIKKEIRDVTAKREIAIAKKYFPLPKSFNIPDILQQVAAINISHKPNLKNIKQKDSTIGQLHQDTAYGLQKFVDDKSLKAIFKTKKAGDEASDDKTTPKDITQYIPMFRNKEDKKAYYDAFREWFKFNGKAASMDAKTKEDKKLKAEIAQKEQAAIQTLRQTALKAFKWFVGGNNFCAEIYEINPNNKIEGVASKDRGEWKTEIVSNYNATVRNSRGEDIAYWRYKYPNAKRIMSLRGNDMVMATFSREQAFDEKFPKGIQEYVREKFQQKSDCQELDILFRVKKMGSNGICFTPHNIAKENADTKSWIASAGAMQKYRVRKIHISYMGRIQNA

SEQ ID NO: 11730 - protein, 1252 aa, synthetic construct
  source 1..1252: note = MG88-3 effector
MKYKFAFDLGSTSCGWAVVNTDEDGNVVGLADMGVRIFPDGRNAKTKEPLQVARRNARGARVRNDRILQRRHKIIDLLKENGMIYDCSDERENPYKLRSDAVDKEITLKQLGRIMYNLSLRRGFKSNRKPTQKENDSDLKKATEKLKQELKGQTLGQYLWGKMKKNLDKEKENKGKDVKNKIGKVRFSNLFDGNKIKDGSVYPSREMYEDEFNRIWSKQAEFHDILTDELKGKFYNAIFFQRPLKPQQRGFCMFEDGELRIYKAHPLFQRFRALQTINQMEIDDKPLTEEQREALKKELFEEFKTKNTKAGTVSFSDIRTILGLKKGVKINLEKNDDDENDGDNTRADKTPEDKDNKKDDDKEYDNIYADKTAYLLSRPECFGEKWFEIPFDEQCSIVDILTDCVYNNIEEKKKYDEQQEQNGKHILEDDEIKQFLQEHYNLDDEQCNAIMNAPLEEGTGSLSQKAIEKILPYLEEGQLYNDACKSAGYHHSLFDGDVEMLGELPYYGDVLKKSCVQDKDGNYRITNISVHVALNQLRLVVNELIKKYGNPDFVAVEIARDLKMGTEELKNLNNKQNSNKKENDKITKAIKEANGNPNNAKDREKFKLWELCQKRCVYTGKQISATELFSDRVHVDHILPFSRTFNNGFFNKVVCFGDANEDKGNSTPYEAFKNGYQGQSYEEILDRVKKIVEAMKEKKMFKKKTVKDKDGKKKKVDIDEFSWRFKEDAMEKFKEQEGLIARQLNDTKYMSRLAVQYLKHICKVEYYTDEEGKEHRKNNCYGLPGTMTDFCRKGWGVNWLKDKSNKEGYRSSHAHHAVDAFVVACMTRGQLQKIASMANWIEEHGGQCQDDKLYLSILFKKCKKPFDTFDRERIYELCDKMPISFKPKLKDPKQENSTVGALCEDTAYSLLEFDKGLNGVFVKREDVGSLVLKDLPNIIDTQADKLIKEYVETEEAFNKFKEYCEKNGIKKIRCKSFADVSTYIPIFKTKEERDEYHKAYEDWFIFEGRSPANETEEQKQERKEKEQELLKIVQQKALKAYKWFVGGNNFCADVYQISPRDKVYTDKKEQGSWKVEVLSNYMATLNKGQALWRKKHPTARLVMRLKIDDMVMGENFTKEEAEQKLQQEIEKWEKSKEMKKYKDKLTEWEKTHEGKEPKKPEKPKSINEIIIEKCNKEKTSSTSFLFRVKKISSDGSVYIRPDFITKEESDKKSVKLSASSYQKYKIRKVFVSPAGKLVDNGFSDKWNDTKCN

SEQ ID NO: 11731 - protein, 1129 aa, synthetic construct; identical to SEQ ID NO: 11713
  source 1..1129: note = MG89-2 effector

SEQ ID NO: 11732 - protein, 1141 aa, synthetic construct
  source 1..1141: note = MG89-3 effector
MDLIFGLDLGIASVGWSVVDDENKRIVDLGVRAFKAAETEDKGKSLNLVRRTSRLSRRRIYRRANRLNSLLNYLIKSGLISSKDEILNNEHHENPWNLRVKGLDGVLSNNQLARIIYHICKHRGFYWSSSAEETEDTEKGKIKKCLAQNSLALTNEHFRTIGETILNKYPDAQRNKADEYTKSISRVLLNEELKQILTVQKEVFHNPLLTDDFFKAILGTGDKKSGFLWKQKPPLQGEQLLKMVGHCRFEKDELRSPKANYFAERHVWLTKLLNLRIYSEDCEDRALTVEEISIVINKIYEQKSDIRYSSLTTAFVKSGIWPKNHQYKYKGLNYDQLTSSKKKKVEDTASTSEDSTDTKKTAKKTNPESKIFYKSSCYQNIKDAYMSNSLEQEWNILSTQISQGNYDRYNRIAYILSIYKDDEEVKKHLLDCGEKSEVAEALLKIRFNGFSALSEKALKKIVPIMEQGKRFDVACSEAGYAHYKQSQDSKEKRKYLPPLFSGREPNGTLIINSELDDLPRNPVVMRVINQTRKVVNALVKKYGSPKSVHIELARDLSKTFEERIDIQKRQEEIKERRQKEQEEFDRIFGVGIRSGKNLEKYSLYKQQDCKSIYSGETIDLGRLFEQGYVEVDHVLPYSRSFNDSQDNKVLVLTKENQNKGNMLPYEYFMSHNLDWNQFEARVLSNKKLRKNKRCNLLKKSLNRNSKKEFLDRNLNDTRYACRFVKNFIDKYLRLSDKADKSGCVVVSGQLTAYLRKHWGLNKNRSENDRHHAVDATVVACCSRRMVQLIGYWSKHKERQYLKDSQSDPDLESDEELLLKKSIGSQKLYFPYPWVKFRKELNLRVFSSDIEELKNELSLFESYTEEDISKVKTLFVSRAIQKIGRGALHADTVRSQTEEMNKEKVAVSRVKLSELSYDRISKIVDSDTRNKNLCNALKRRFEAYCKSNNINEISKLKAKDSAKIFTTNNPMHMPNSNGEEDPLNPVVRTVRVKETFSGVPIRHGIAGNGDIFRVDIFFKEGKYYLVPIYAIAKELPNRACVAKKHESEWTVIDDTYQWCFSVTQYDLIKIELKKETYFGYFNGFDRATGAVNIILHDRSTEKYKKGLIRSIGLKTAKSVTKYRVDVLGNYYLAGAEKRLELA

SEQ ID NO: 11733 - protein, 1141 aa, synthetic construct; identical to SEQ ID NO: 11732
  source 1..1141: note = MG89-3 effector

SEQ ID NO: 11734 - protein, 1082 aa, synthetic construct; identical to SEQ ID NO: 9066
  source 1..1082: note = MG94-1 effector

SEQ ID NO: 11735 - protein, 1201 aa, synthetic construct
  source 1..1201: note = MG2-4 effector
MNSTRSTPLVLSFDIGYASIGWSVAEVVDPANNLQAGVVTFPSDDVLNSERAGHRRARRNIAARRNRVQRLKLASVGAGFVTAEEIETLDRMERKSAPEWRHCPWFLAARVLGESPESTLTGLQLFHVLRWYAHNRGYAPPSWGLFDEADGEQEEDFEKVRNAEKAMHEFGADTMAQTWCALLDADPTAGRWPEPRHWAKGENMAFPRERVQAEVTRLLVAHVGKLPGVTSDFVRCLIDDWEHHPKIRSWLQGADPRTGKLRDYALPKRYEGGLLFGQHIPRFDNKIIPWCPFTLKEDTNSGKISGRNVPKKHSRAFLDFKVAMRLNDLALSELGESGGRLSAGQRMTLFKRIEGYGDVTVRQFADLVAEVCAIPKPDLTTRIPEREGSDRPFELRPERKALIAILTGGRSLPSWPLIHSIWDCFEDAEAVLRPVFHGKPTSWADLIEQAKAPDVLLERLEELFRLGKGKPSRSKKAQPPPDFEVLLRCKITITKAHGRARYCSDKLRAATDEALGGLDPRRAPTTETSDDAGCLYLNERQRDLQDRLPLSKLTNNHLVRHRLLIFRRLLQDLVNTYANGDRERIDAIVVEVARDLNEYSGKNTKQRVALFQEKQRPFNDAAEAFAQALIDDAQYTPEQAQALATYANVRRFRLMREQNFECPFTGRHLSAEDIAKDRVDFEHIIPRSLKPTDSLDAMVITYRAVNQAKRNRTAMRFIKDMAGERLDADDAGWSYHTPQQFETAVNRMRPKGRLNTAAKRSQANRCDALLVEDYEPREADFLQRDLTQTGYLMKYAVGEARKFFRSAPRQPRFIHLEGRVTTFFKKAWRLTETLAPISPLFLREYADPRTGRWQSTVRPKAELRRFTQLHHALDALTLGLATALVPGIERKELRRALSLRQAKGDDATLLRSDPKLGEALRWRTEDRFEAAPLSGKLESAVRRALAEGRVVQHVPAKRQGMKVDSNFFGFVEFDETGRLRVRQKMRSPTTRRREIKTTVKNGKNLHTLSHLSLDPKSWLGAPDHPLRRKQLEHGLRTENDLANPKLGNIRGMLPIRENWGIALITKDGSPRLDVIPYINVHQWLEVLALENGGGSPVVLRKGHLVGFDAEKCPEEYCGAWMLLGVKDGRSGTTLELIRPWMVAPRKGGTKESSAKQAIKPASGYSEKEGKASGVFLQRSADVFLKLGLRPLDHDLTGIAAF

SEQ ID NO: 11736 - protein, 915 aa, synthetic construct; identical to SEQ ID NO: 1513
  source 1..915: note = MG21-2 effector

SEQ ID NO: 11737 - protein, 1542 aa, synthetic construct; identical to SEQ ID NO: 1657
  source 1..1542: note = MG22-2 effector

SEQ ID NO: 11738 - protein, 1375 aa, synthetic construct; identical to SEQ ID NO: 1757
  source 1..1375: note = MG23-2 effector

SEQ ID NO: 11739 - protein, 1132 aa, synthetic construct; identical to SEQ ID NO: 426
  source 1..1132: note = MG3-3 effector

SEQ ID NO: 11740 - protein, 1134 aa, synthetic construct; identical to SEQ ID NO: 427
  source 1..1134: note = MG3-4 effector

SEQ ID NO: 11741 - protein, 1043 aa, synthetic construct
  source 1..1043: note = MG4-2 effector
MLREPGNSVKSKIMGQQAKRRSYVLGLDIGTHSVGWALLKFRDGRPCGVERAGVRIFEPGVEEVAFERGRAEPPGQKRRQARALRRQTERRARRKAKLLHILQRAGLLPKGEADEILPALDRDILARHSAAWPGARDALPYWLRSGALDHRLEPHEFGRALYHLGQRRGFLSNRRAPMRKNEEDGKVKAGISTLKEQMEKAGARTLGEFFAGLDPHQERIRQRYTSREMYEQEFEAVWSAQAAHHPAILTDDLKARVHHAVFHQRPLHNQSYLAGSCTLEPDRKRTPWACLIAQRFRMLQKLNDTRVLPASGPERPLSDEERQTVLTELDRKKELKFDRVRKLLGLSADSSFNWESGGEDRLVGNTTNARLAKVFGKRWWSLSPDDRDQVVEDVRSYEKAEALARRGREHWGLDEKAAGELSKLSLEDGYCRLSRQAIERLLPGMEKGTAYMELVRKLYPDRWAAGKPVDLLPALAETDLDMRNPVVRRCLTELRKVVNAVVRHYGKPSAIRIELARDLRKSAKQREQTWRRNRRNQQDREAAAEKLLQEARIANPSRADVEKVLLAEECGWHCPYTGHGFGMADLFGPHPHFDVEHIVPFSRSLDNSFLNKTICEARENRDRKRNHTPYEAYGADAERWDQIIARVQSFRGTASREKLRRFQQHEVEDLDGVAQRELNDTRYASLLAVQYVGMLYGGAVDAGHVRRVQAAKGGTTGYLRDMYGLGFVLGEGRKERSDHRHHAVDAVAIALTDPAALKSISQAASDERRGGRVSFGAVALPWVDFIGDVQAAIEAINVSHRPSRKVNGALHEETFYGPRGMDGDGRPTGYVQRKPVERLSAKEIPNIPDPAVREAVQAKLDEVGGTPAQAFKDPANHPVRKRGIPVHKVRLRLNINPVQVGSGATERHVLTGSNHHMEIIEVRDAKGGKKWTGRLVHRLEAKRRALGRETIVDRAVQAGRQFQFSLSPGDMIELTGEDGERKLHVVRSISEGRIEYVDARDARKKADIRASGDWRKPAVGSLLRLHCRKVVVTPFGEIRYAND

SEQ ID NO: 11742 - protein, 1334 aa, synthetic construct
  source 1..1334: note = MG44-1 effector
MEKFYLGADIGTNSVGIACTDENYELIRAKGKDCWAVRLFDESKTAETRRNFRTSRRRLERRKQRISWLQALFAPYINDETFFIRLNNSQFLPEDKDEILQADKNALFGDEGYTDKNYHVEFPTIYHLREKLIEGGKYDLKLYYLTIHHIVKYRGHFLFEGATMEEIRDIKRLFENLNAVWEATYAENVPHINLAKSDEAKEILLDTKKGLRDKQIALEKLFGENTALMKESIKAMLGGKISPETLFGEEYKDEKSFSFKDMDEEAFDALQSTYGDNFECLNALRSIYNFVAFEKLLCGHKNISSAMIAVYNKHAADLSLLKSFIRSERPNDYNKIFKSTTEKANYVNYIGYTKKGGEKKKVAKCKSDDEFFAYMKKYLSSLDDIKDGATRDKILGEIENGSFLPKILHSDKGLFPRQVNEAELKAIASNMVKYYPETKEIADKIIPLFEYRIPYFVGPLAGVNSWAVRKSGEITPWNIGEKIDLAASNEEFMRKMTSKCSYIFGEDVLPKCSIIYQKFDVLNQLNKLRVNDRPLTVDLKKGIFNELFLKYPKVSDKKIKDYLIRNGHFSPTDGEITLSGKDGEFKASMSSYIQLKRILGDFVDKDLENGGEVCENIILWHTLNTDKKIVYDLIEKRYKNIPEIADSVKALKGLSFKNFGRLSKKFLVDLYSADNETGELVNILDVLYETNENLNEILNDEKYAFGKLVDEANGVADSKITYEDIEKLYVSPAVRRGIWQTVTMIDEYVEAIGRTPDKIFVEVTREDGVKGDAGRTQPRKRQLQEKYKNVSKTYADVISELGDEKYSDMKLRQERLFLYFRQLGKCMYSGQRIDLDRLDTDTYDVDHILPRTFIKDDSLDNKVLVLRSKNAEKADRYPLPQGFSDQQDFWKMLLDKNLIAKTTYDRLTRTEPLGDNDYKDFINRQKVITDQTVKAVAELMKRKYPTAKIVYSKAKNVNDFKNKFDIFKCRETNDLHHARDAYLNVVVGNVYDTVFSNPLDMFRKDGDMWRTYNLKKLFTRDVKGAWDCSRIARIKSICGSHTMAVTRYAYCNKGEFYNQTVYGKDDAGVSSPRKSNGPLSDTKKYGGYKSQTTAYFAIVSSLDKKDNRVKTIEAVPVLVAYRLKNNPKAVEEYFNSYLKSPEVLIPKIKNKQLVSYNGSLVYIAGVTGDRISVHNATQLFTDNKMDEYVNGLLKLLDMDAKKMLVGDEPRYVIKTNRNKEEKLVIDKEKNVELYGYLKNKLCDKIYSGLSAFATFAKNIENGKEKFIDLTIVEQAKVLIQILMMFKRKDILSDLTLIGGSSHSGKILFNKKIDDVNFEIIHLSPAGLRVIKNKV

SEQ ID NO: 11743 - protein, 1352 aa, synthetic construct
  source 1..1352: note = MG46-1 effector
MKENYYLGLDIGTNSVGYAVTDGGFNLLKYKGEPMWGSHVFEEGKQCSDRRMHRTARRRLDRRQQRVHLTQEIFAKAISEVDERFFVRLKESALFREDTSGRDTYIFFQDENYTDKEYHRDYPTIHHLIKELMEDTTPHDVRLVYLAVAWLMAHRGHFLSEVNKDNITELLDFDSIYGNLMELFTTPPWICSDKEEFKNILLLHQTIKNKERKFWGLLYEGKKPKTDEEDYINKEGMIRLLSGGTVEAGKLFNQKEFQEKISISLKKSEEDFQLLLDEMDEEDSEYLIRLRALYDWALLVDSLHGCSSISEAKVQDYAQHEADLKMLKNFVRKYCPNEYAAIFKNAEKENYASYVYNIPKGKRTKEYKKKITQEEFCDYLKKKLKDIQIEEEDQEIYQDMMFRLETYTFMPKQVTGDNRVIPYQLYYDELKKILENAENYLPFLKKVDEQGISNKTKLLSIFEFRIPYYVGPLCSASKYAWLKRKAEGKIYPWNFEEKVDLDQSEKAFINRMTNNCSYLPGETVLPQNSLLYCKFTVLNEINNIKINGIPISVECKQEIYRLFEENKKVTVDKIKKYLISNNYMEKEDVLGGIDITIKSSLKPQHDFKRLLHSKILNEKEVEQIIECITYSEEKSRVLRRLEREFPKLSDEDRRYLSKLKYSGFGRLSREFFTGIHGANKETGESFSIIQALWDTNDNLMQLLSDRYTFKDSIEEEQRQYYEEHPMTVESLLEEMYVSNAVKRPIYRTLDVIKDIQSVCKAAPKKIYIEMARGQEEGSNRKRSRKDQILELYKNMDKGEVRELSKQLEDCSDRELRSEVLFLYFMQLGRSMYSGKPIDIEKLKTNAYDVDHIYPQCRVKDDSLSNKVLVLSEENRAKGDKYPISAVIRQNMGEMWRVYHEKGLISDEKYRRLTRVSAFSNAEKMEFINRQLVETRQSTKALTRIFRYIFPETEIVFVKAGLVSDFRNEVLKCAKSRIVNDLHHAKDAYLNIVAGEVYHARFTSKFFKIDQDEYSVKTKAIFGNKVWNGKELVWDGEKDIARVKKILTKNSVHYTRYAFERKGGLFDQQPLRAASGLIERKAGLDTEKYGGYNKSTASYFLLVKYAEAGKKPKQDVMFVPIDLMESEQIIKSESYAKYYVRNAIAHIIGKSREIVQEVSFPLGMRKMKVNTLLTLDGFEAILASKSNGGKTLVFGSMMPLFVNNKKEIYIKRLESFSKKKKQNNFLFVDEVYDKITKEENRELFLFLTNKVEEEPYCLIFGSQLQVLHDKENEFENLNLEQQVETLLNLLSIFKTGRTTGCDLKLLGGAGQAGIFTESSKLSNWKKSYKDVRIVDISAAGLHRKTSQNLLELL

SEQ ID NO: 11744 - protein, 1027 aa, synthetic construct
  source 1..1027: note = MG6-3 effector
MKKVLGIDLGVASIGWGIIETDEKNENGRILKSGVRIFQGNEQRADAAPGESSNADRRNKRSVRRQRDRRTRRKINLYVTLKKNGLAPNKSEWDKWVSINPYTIRAKALDEKVSLHEFGRALYHLNQRRGYKSNRKAGSDKEGAVKEGISKVRNHMAKHNARTIGEYFHEIYDNHLQNDTEHDDFDWRIRDKYTHRKMFKEEFDALWDAQSVFHKELTNDLGEVLKKIIFHQRKMKSQSHLIGKCELETDKKRIAKAHLLFQEFRVLKNINNLSISDENGFPIKLTEGDRKLFKEIFDKKDKVSWSQLKTALINSGTIGNKNAVFNLERGGRKNIEGNRTNAALSHKKAFGEKWYELEDDFKKHVVDVLIHVDKPEIVKNLALNKWDRTEEQAEYITHKLTLEQRYGGFSEKAIKKLLPYLKKGMEESSAIKKAGYSLFEQNPGKMNQLPMPDQTIKNPVVYHALIELRKVVNGIIREYGMPDVIRVELARDLKAGYERRQKMTKKMRELEKKNDKAYKALQKEPFNIQYPGYNDIIWFNLWEECDKTCPYTGKTIPAEAFNSGEFQIEHILPFSRSLDNSYANKTLCEADFNRKKGNRTPWECVEAGIMEEDTMLQRIRNLPWNKRNKFTQKEIDEDKFLNRQLSDTRYISKEASSYLKHLSCERVEVVKGQTTSLLRHLWGLNGVLNKEGPDMKNRDDHRHHAIDAIVVAFTNRSTLKRLSDENKRIGTAEWMDADESGRATNDEIKRRLGGRIDLSEPWPTFRNDVEVSINNITVSHRVNRKVSGALHEETYYGPTDEPAPKNKEMMVLRKSVHQLSKKDLGLIRDETIRQIVNDEVQKRMDNGESQANAIASLEADPPFIISPKAKVPIRKVRLLMKKDPQIMHYFENKNGEEDRAALYGNNHHIAIYETSDKNGVKKQIGIVIPMMEAARRVKDGDPIVMKDYRPDHTFLYSLAKNDMIFNHEDEQIYRVQKINSDGTIMFRQNNVAMKGQSDPGVYFKSGSRLGASKIKISPIGEIFPAND

SEQ ID NO: 11745 - protein, 1005 aa, synthetic construct
  source 1..1005: note = MG6-5 effector
MDSYTLGLDIGSNSIGWSLIKEDKNPTIIDIGVRVFPEGIDRDTKGAEISKNKTRRNARSSRRMHQRRSYRKSKLVKISREQGILPQEDKELDKLFLKDPYELRAKGIDEKISLFEFGRALFHLNQRRGFLSNRKSGKSKEDGVVTKSASELQSTIKKTGCRTLGEYLNKLDSTEERRRSYYTFRSMYEEEFEKLWEKQKEFYPKILNDDLKKVIKDETIFFQRPIRWDRDTIRDCDLEPGEKVCPRSDWHARRFRILQDINNLEIYNTDGSSDKLSDERRKVLLEELLNKKDMTFGALRKKYGLFESQTFNLEEGSADKKKAKLKGDEFAAQMRSAKILGKKGWEKLNESQRIEINDLIVDDDIEDNELVKILIDKYRFSQTQAEATLDISLPSKYSSFSKVALQKLLIYMEKGKLVHEAIQAVYGKPQAITNKGEIMDFLPMPEDLRNPIANRGLFEVRKLVNAIIREYGKPKKINIEMAREVKGSKRERDEIHLKQYKNERINEEARKTLIDDFKIPNPSRDDIIKYKLWVECNKVCPYTGKSISQHQLFGPNPEFQIEHIIPYSRCLDDSYMNKTLCFVDENKEKGNETPYEYYSEKIPKQYEQILQRIRTLPYPKRRRFSQQEVKLDNFIERQLNDTRYISREVVKYLKKLGVIVKGTRGQVTSELRHQWGLNNILDLAGEGLKNRDDNRHHSIDAAVTAVIGNEHLRELARTKFRKNNKEFKQPWPDFREELEEKIKHINVSYRVQRKVSGALHEETSYGPTGRKDEKGQDIFVYRKKLEDLTISMVNKIVDLVVRDIVKKRLVERGIDPEKDKKIPKEVWNEPLYMKTTKSDKKVQIRKVRIQDVFNNMIMLKDKKGKPCRAVAPGNNHHIEIFEYKDKKGGKKRDGRVITMFDAVQRSQKRESVVKRDYGDGKEFVCSLATNEMFIMDNVDGNTELYRIQKITQSGNNKTIILRPHTYAGKLSDSDKPPLIQRKSPNTLKGHKVTVDMLGRFHMAND

SEQ ID NO: 11746 - protein, 1168 aa, synthetic construct
MSNKTILGLDLGVSSIGWAIIERNDENGRIVKSGVRVIPSSKSELSVFKDFDKGKPASFSKERTEKRGIRRSYFRKKLRRAKLIEHLKENNMFDPELLGPKYSIDVWEWREKATKEKITLAQLGRVLLHINQKRGYKSNRKAIVDEESDSNWLNAINDNSKLLREKGITVGEYFYQEGKLHERKPKVKFALHFRMKVRIFNRKDYLDEIEQIWKKQSEFYPELTDELKESIIDHTIFYQRPLKSAKHLLSECRYEKMHKVIARSNPLFQLFRVLEKVNNLRAEDAFGNNREITDEEKLKIIEACTSAQSWKLLDKKKNLSKSKIKSILGLGKDYEINLDSIEGSKTLHSIWEVLMKSWGEAGDWIDFDWSIQGNDFSKQKSYQLWHALYSIDEPQYLRKKLCEGFGFDLDTARLLMNIRLESDYGALSARAIKRIIPELLKFPKDATKAIENAGYKFTDSETKEERESRELKDRIEHLKKGALRNPVVEKVLNQLVTLVNAIYAHPELPNPDEIRVELARELKSGAKERRRAELGMARAAKDNDRIRELLQTEFGIPYPGRRDILRYRFWEEQDMRCVYSGDVIPRNKLFVGEEYELDHIIPRARLFNDSNSNLVLVKSSENKDKSDMTAADYMKSKGEKAFEEYLVRVKNLYDKGAKKKAGERGSGINKGKRNFLIMKKEEIPQDFIERQLRESQYIVKEAVKLLKEVCRDVTTTTGKITDLLKHQWGANDVFRNIQVPKYRKWGMTETIVDRKTGEVIERIIDWSKRKDHRHHALDAIIVACTRQSYIQQLNRLNVLYENDYESLKSYRKFELPWPSFHNDLISSLESLLVSFRNKRRVATMNKNRIKVGGKKKYIVQKTLTPRDAFHLETTYGRRLVNNYKLVKLNKKFSMELAELVIDPDLKEKILNRLMEFGNDPQKAFANLKKNPFKWKNENLEEVLIYDEVFTTRKKLDEKFNNPSEIIDPEVREIVTQRLKEFDNNPKKAFADIENKPVWYNKDKQIRIKTVNTRAKASDLYPVRTKENGNPKDFVFTRNNHHITVYQKEDGKYYDKVTSFWEAFELKKAKMPIYKENDDAAKAVLHLKINDMVLVDLNPEDLDQNDPEFFNTLSEHLYRVQKLASGDVTFRHHLETELSNKNTEVRVTNAESLYNRVVMYPLDVLGLPK

SEQ ID NO: 11747 - protein, 739 aa, synthetic construct
  source 1..739: note = MG71-1 effector
MDNLILRREKMLVTKIKNTYPQISDDEIKAIKKLKYKDWGRLSATLLNSSTIAYEDKAFGELVTIISALRHTNKNFMELLSSYCSYDFIGKIKEFNGSRQSSNGKLTYKDVEELYVSPSAKRSIWQTLTILEEIKKIMGCEPKRIFIEMARSKEESKRTDSRLKKLQDLYKKCREENIDFMPRKDEFNALKTQLSSKKEEDLRSDKLYLYYTQMGRCMYTGERIELASLYDNNLYDIDHIYPRSKTKDDSLSNRVLVKKQVNAAKTDIYPLDAAIRTKMHSFWKLLYDKGFIDERKYERLTRSTQLRDEELAGFISRQLVETRQSTKAVAAILKTAYQNSEVVYVKAGNVSDFRQQFKFVKCRDVNDLHHAKDAYLNIVVGNCYHVKFTANPLNFITKNQDNRRYSLKPEIFYKFSIKRDGEIAWLGGEDGTMATVARTMHKNNILFTRQPLEGKGELFKQNPLKAKSGQLPLKAGLSVEKYGGYDSLTTAYFALVKSEGKQGSVQLSIEGIPLVYAKQGEKAVQDYLTEVVQLCKPEIKIPKIKKYSLFKINGFPMHISGRTGKQLVFYGAGQLCIADDVADYLKKALKHETDIAEKEKTLADQNADDIQKQKAQKGLDFYEQKWGISGAVNVQLYDMFIAKSANNLYKNRPASQTITLKEKREHFVKLTLSKQIHIIKEILNLFKCASASADFKLIDKGTSCGTLKISNNITKLKECILINQSPTGVFEQEVDLMKL

SEQ ID NO: 11748 - protein, 1168 aa, synthetic construct; identical to SEQ ID NO: 11746
  source 1..1168: note = MG99-1 effector

SEQ ID NO: 11749 - protein, 1172 aa, synthetic construct
  source 1..1172: note = MG112-3 effector
MGYNKVVLGLDVGVGSIGWGLVQLDEEKYADEKQDGTVEEKYKITDGKIIAAGVRRFQLPQDRQKKSLALIRGTARRSRRTIKRRARRLKRLIELGKEFNLLGNDFDRDKFLIPKKGDKKEKWDTWRFRKEALERKLTDEEFFRVLYHIAKHRGAYFQTRAERLELEKDSKAAKDQGEKGEEKQDNEKKKEREKMKKGLKRIQELLKRSQYKTVGAMFYEMFKNGRKRNAPDKYSNSIRRELLHDEINEIFKAQRALGNEKADPDLEKQYLRAVLMQEKGPDDEKMQKMIGRCEIIKELCSQAGKECTADCPDLNRCRCAPKESYTAERFVLFNRLNSLKIIGGQAIDLAKHRDNIEKLAYTHDKIDFSQIRKELCLTDKPHLRFNLCSYSEKNPEYEKTLKYEVSNGQLQFGPEHRVQMDNFDTGETKVFDKEIRAIFQKRLATTPNYKKINVRYSDIRKELQGPQVDLAGFKFTALKKEYTKSSAQLESEFFTKPKNKGKNFNGDAAYIKQFEDDAIFVELKGYHKIRKVLENRDGTWEKLKSDGTRIDTIAEALTYCKKDETRTAYLKERGITDESVIDAALTLNMEKIATYSKEAMVKLLEHMEKGLLVNDAKARCGYDKFEHKKQAYLAPYSGFFENNPVVARVIAQTRKVVNAIVRKYGEQYPIDQIHIEVATELANSEKTRKRIKDAQDKNKDEKSRARSICEEFGINSDEGQNLTMVRLLDEQGHFCPYTGKAIVLRSTGAANEVHINDCEIDHIIPMSRSFNDGMNNKILCCAKANQDKRNRIPFEWFEETHGPNSQQWFEFTRRVEKMYDVPYSKKKNLLRKSWTDEEMKKFMDRNLNDTRYATRHIADYLRKYFDFSNRRDDIKDVSRIKLRSGGVTAFLRYLCGLNKNRDENDLHHATDALITACATDGHVFLVSNLSKQIEEKGKNWYKHFGMEKFKPLRPWETVREDILEATQKIFVSRMPRHKVTSAAHEDEVWSFDEKKRTKKAQKKKKSSIPKDTARVMKINNGYAKIGEIVRADVFEDGKHKNYVVPIYAVDIFSKKPLPDKYLKKNNTPYDEWPSAAADNLTFKFSLFKDDLITINGTPYYVDFVEGTQANIKVRNINGSKFESTNEKTRKFGYRNIELKKFSVDMLGNYKEVKEEKRLGNEGVKWTKKRPKK

SEQ ID NO: 11750 - protein, 1014 aa, synthetic construct; identical to SEQ ID NO: 11617
  source 1..1014: note = MG123-1 effector

SEQ ID NO: 11751 - protein, 1020 aa, synthetic construct; identical to SEQ ID NO: 11625

SEQ ID NO: 11752 - protein, 1088 aa, synthetic construct
  source 1..1088: note = MG125-1 effector
MRPYGIGLDIGISSVGWAAIALDHQDSPCGILDMGARIFDAAENPKDGASLAAPRREKRSQRRRLRRHRHRNERIRRMLLKEGLLSEAELTGLFDGALEDIYALRTRALDEALTKQEFARVLLHLSQRRGFRSNRRATAAQEDGKLLDAVSENAKRMADCGYRTVGEMLYRDAVFAKHKRNKGGEYLTTVSRAMIEDEVKLVFASQRRLGSAFASEALEQGYLDILLSQRSFDEGPGGNSPYGGAQIERMIGKCTFYPEEPRAARACYSFEYFSLLQKVNHIRLQKDGESTPLTSEQRLQLIELAHKTENLDYARIRRALQIPDAYRFNTVSYRIESDPAAAEKKEKFQYLRAYHTMRKAIDGASKGRFALLSQEQRDQIGTVLTLYKSQERISEKLTEAGIEPCDIAALESVSGFSKTGHISLRACKELIPYLEQGMNYNEACAAAGIEFHGHSGTERTVVLHPTPDDLADITSPVVRRAVAQTVKVINAVIRRYGSPVFVNIELARELAKDFTERKKLEKDNKTNRAENERLMRRIREEYGKMNPTGLDLVKLRLYEEQAGVCPYSQKQMSLQRLFEPNYAEVDHIIPYSISFDDSRRNKVLVLAEENRNKGNRLPLQYLTGERRDNFIVWVNSSVRDYRKKQKLLKPTVTDEDKQQFKERNLQDTKTMSRFLMNYINDHLQFGVSAKERKKRVTAVNGIVTSYLRKRWGITKIRGDGDLHHAVDALVIACATDGMIRQITRYAQYRECRYMQTDTGSAAIDEATGEVLRIFPYPWEHFRKELEARLSSDPARAVNALRLPFYLDSGEPLPKPLFVSRMPRRKVSGAAHKDTVKSPKAMAEGKVIVRRALTDLKLKNGEIENYFDPGSDRLLYDALKARLAAFGGDGAKAFREPFYKPRHDGTPGPLVKKVKLCEPTTLNVAVHGGKGVADNDSMVRIDVFRVEGDGYYFVPIYIADTLKPVLPNKACVAFKPYSEWRTMDDRDFIFSLYPNDLIRVTHKSALKLSRVSKESTLPESIESKTALLYYVSAGISGAAVSCRNHDNSYEIKSMGIKTLEKLEKYTVDVLGEYHKVEKERRMPFTGKRS

SEQ ID NO: 11753 - protein, 1087 aa, synthetic construct
  source 1..1087: note = MG125-2 effector
MLSYAIGLDIGISSVGWATVALDGEDRPSGIIGMGSRIFDAAEQPKTGDSLAAPRREARSARRRLRRRRHRKERIRALILREGLLNETQLAALFDGQLEDIYALRVRALDEAITAEALARIMLHLSQRRGFLSNRKTAASKEDGELLAAVSANRARMQAHGYHTVGEMLLKDESYREHRRNKGGAYISTVGRDMIVEEVRQIFAAQRTFGNVAASEALEANYLEILLSQRSFDAGPGEPSPYAGSQIENMVGKCTLEPDESRAARATYSFEYFALLEAVNHIRLTGAGVSAPLTAEQRERLIALAHKTADLSYAKIRKELNIPAEQRFNAVSYGKSDSPDEAEKKTKLKQLKAYHQMRGAFEKASKGSFVLLTKEQRNAIGQTLSIYKTGDNIRRSLRDAGLSEEQIAIVEGLSFSGFGHLSVKACDKLIPCLEQGMNYNDACAAAGYAFRAHEGQEKKKLLPPLNAEAKDTITSPVVLRAVSQTIKVVNAIIRERGGSPTFINIELAREMAKDFSERTQIKHEHDENRKQNERLMERIKNEYGKSAPTGLDLVKLKLYEEQAGVCAYSLRQMSLEHLFDPNYAEIDHIIPYSISFDDGYKNKVLVLAKENRDKGNRLPLEYLNGKRREDFIVWVNSAVRDWKKKQRLLKEHITQEDEAKFKERNLQDTKTASRFLLNYIADNLAFAPFQTERKKHVTAVNGSVTAYLRKRWGITKTRANGDLHHAVDALVIACTTDGLIQKVSRYAQYQENRYSADGGLVVDLHTGEVVAQFPEPWAHFRQELDARLSDDPARAVRGLGLAHYATGEIRPRPLFVSRMPRRKITGAAHKETIKSPRALDEGLLITKTPLDALKLDKDSEIAGYYKPESDRLLYEALKERLRQFGGDGKKAFAEPFRKPKHDGTPGPLVTKVKLCEPTTLSVAVHGGLGAANNDSMVRIDVFHVEGDGYYFVPIYIADTLKPELPNKACVAGKKPSEWKRMNPNDFVFSLFPNDLIYVSHRKGICLSLVNKESTLPASREEKCTFLYLVKGKSSTASLECRNHDNTYHIKSLGIKTLEKIEKYTVDVLGEVHKIEKEPRMPFTNMEG

SEQ ID NO: 11754 - protein, 1087 aa, synthetic construct; identical to SEQ ID NO: 11627
  source 1..1087: note = MG125-3 effector

SEQ ID NO: 11755 - protein, 1087 aa, synthetic construct
  source 1..1087: note = MG125-4 effector
MRSYAIGLDIGITSVGWATLALDGNENPCGIIGMGARIFDAAEQPKTGESLAAPRRAARSSRRRLRRHRHRNERIKNLMVSKGVLSSDELETLFDGRLEDIYALRVKALDGKVSRSEFARILLHLSQRRGFRSNRKNPSSKEDGALLKAVSENAERMEKHGYRTVGEMLLCDEAFKQHKRNKGGNYLTTVTRDMVADEARAIFAAQRSFGSEYASEEFENEYLEILLSQRSFDEGPGGNSPYGGSQIERMIGRCTFFPEERRAARATYSFEYFSLLQKVNHIRIVTNGAAERLTAEQRNTVIELAHTTKDLSYAKIRKALKLSDGQLFNIRYSDKASAEDTEKKEKLGVMKAYHQMRSAFEKQSKGRFDFVTTPQRNDIGTALSLYKTSDKIREYLKDSGFDEIDMDAVESIGSFSKFGHISVKACDMLIPFLERGMNYNEACAAAGLNFKAHDTGEKTRFLHPTEDDYEDITSPVVRRAISQTVKVINAIIRKEGGSPTFINIELAREMAKDFTERNKLKKENDENRAKNEKLLERIRTEYGKSDPSGLDLVKLRLYEEQGGVCMYSLRQMSLEKLFSPNYAEVDHIVPYSKSFDDSRKNKVLVLTEENRNKGNRLPLQYLTGQRRDDFIVWVNNNVRDYRKRRLLLKETLTDEDELGFKERNLQDTKTMSRFLLNYISDNLEFAESTCGRKKKVTAVNGAVTAYMRKRWGITKIREDGDLHHAVDAVVIACTTDGMIQRVSKYARLRECRYMPTEEGSLVIDDGTGEVLHQFPYPWRDFRKELEARIGTDPARTINDLRLPFYMSSGMPLPEPIFVSRMPKRKVTGAAHKDTVKSPKELDKGCVVVKRPLTDLKLKDGKIENYYNPQSDRLLYDALKKALIEHGGDANKAFAGEFHKPKSDGTPGPIVSKVKLLEPTTLNVPVHGGAGVADNDSMVRVDVFLTKGKYNLVPIYVADTLKPELPNKAIAAHKPYSEWPEMSDDDFIFSLYPNDLVCVTHKKGIKLTVTNKNSTLPPTVEGKSFMLYYISTNISGGSIKGITHDNTYEIGGLGAKTLEKLEKYTVDVLGEYHKVGKEVRQPFNIKRR

SEQ ID NO: 11756 - protein, 1095 aa, synthetic construct
  source 1..1095: note = MG125-5 effector
MRPYAIGLDIGITSVGWAALALDADENPCGIIDLGSRIFYAAEHPQTGESLAAPRREARGSRRRLRRHRHRNERIRSLMLEERLISQDELETLFDGRLEDIYALRVKALDEIVSRTDFARILLHISQRRGFKSNRKNPTTKEDGILLAAVNENKQRMSEHGYRTVGEMFLLDETFKDHKRNKGGNYITTVARDMVADEVRAIFSAQRELGASFASEEFEERYLEILLSQRSFDEGPGGNSPYGGSQIERMVGRCTFFPDEPRAAKATYSFEYFTLLQKVNHIRIVENGVSSKLTDEQRRIIIELAHTTKDVSYTKIRKALKLSDKQLFNIRYTDNLPAEDSEKKEKLGLMKAYHQMRSAIDRISKGRFAMMPRAQRNAIGTALSLYKTSDKIRKYLTDAGLDEIDINSADSIGSFSRFGHISVKACDMLIPFLEQGMNYNEACAAAGLNFKGHDAGEKSKLLHPKEEDYEDITSPVVRRAIAQTIKVINAIIRKEGSSPTFINIELAREMAKDFRERNRIKKENDDNRAKNERLLERIRTEYGKNNPTGLDLVKLRLYEEQSGVCMYSLKQMSLEKLFEPNYAEVDHIVPYSISFDDSRKNKVLVLTEENRNKGNRLPLQYLKGRRREDFIVWVNNNVKDYRKRRLLLKEELTAEDESGFKERNLQDTKTMSRFLLNYIADNLEFAESTRGRKKKVTAVNGAVTAYMRKRWGITKIREDGDCHHAVDAVVIACTTDAMIRQVSRYARFRECEYMQTESGSVAVDTGTGEVLRTFPYPWPDFRKELEARLANDPAKVINDLHLPFYMSAGRPLPEPVFVSRMPRRKVTGAAHKDTIKSARELDNGYLIVKRPLTNLKLKNGEIENYYNPQSDKCLYDALKNALIEHGGDAKKAFADEFRKPKSDGTPGPIVNKVKLLESATMCVPVHGGKGAAYNDSMVRVDVFLSGGKYYLVPIYVADTLKPELPNKAVTRGKKYSEWLEMADENFIFSLYPNDLICATSKNGITLSVCRKDSTLPPTVENKSFMLYYRGTDISTGSISCITHDNAYKLRGLGVKTLEKLEKYTVDVLGEYHKVGKEVRQPFNIKRRKACPSEML

SEQ ID NO: 11757 - protein, 1134 aa, synthetic construct; identical to SEQ ID NO: 7377
  source 1..1134: note = MG3-18 effector

SEQ ID NO: 11758 - protein, 1132 aa, synthetic construct; identical to SEQ ID NO: 7369
  source 1..1132: note = MG3-89 effector

SEQ ID NO: 11759 - protein, 1132 aa, synthetic construct; identical to SEQ ID NO: 7370
  source 1..1132: note = MG3-90 effector

SEQ ID NO: 11760 - protein, 1138 aa, synthetic construct; identical to SEQ ID NO: 7371
  source 1..1138: note = MG3-91 effector

SEQ ID NO: 11761 - protein, 1110 aa, synthetic construct; identical to SEQ ID NO: 7372
  source 1..1110: note = MG3-92 effector

SEQ ID NO: 11762 - protein, 1108 aa, synthetic construct; identical to SEQ ID NO: 7373
  source 1..1108: note = MG3-93 effector

SEQ ID NO: 11763 - protein, 1131 aa, synthetic construct; identical to SEQ ID NO: 7375
  source 1..1131: note = MG3-95 effector

SEQ ID NO: 11764 - protein, 1133 aa, synthetic construct; identical to SEQ ID NO: 7376
  source 1..1133: note = MG3-96 effector

SEQ ID NO: 11765 - protein, 1132 aa, synthetic construct
  source 1..1132: note = MG3-103 effector
MSADSLNYRIGVDVGDRSVGLAAIEFDDDGFPIKKLAMVTFRHDGGMDPATGKTPKSRKETAGVARRTMRMRRRKKKRLKDLDKKLRDLGYFVPRDEEPQTYEAWSSRARLAESRFEDPHERGEHLVRAVRHMARHRGWRNPWWSFSQLEEASQEPSETFGRILERAQHEWGERVSDNATLGMLGALAANNNILLRPRRYEHNPKTGKNAEKLNVRGQEPILLDKVRQEDVLAELRRICKVQGIEDQYPELAHAVFTQVRPYVPTERVGKDPLQPMKIRASRASLEFQEFRIRDAVANLRIRVGGSERRPLTEEEYDRAVDYLMEYSDTTPPTWGEVADELEIAENTLIAPVIDDVRLNVAPYDRSSAIVEAKLKRKTQARQWWDDDANLDLRSQLILLVSDATDDTARVAENSGLLEVFESWSDEEKQTLQDLKFDSGRAAYSIDTLNKLNAYMHEHRVGLHEARQNVFGVSDTWRPPRDRLDEPTGQPTVDRVLTIVRRFILDCERAWGRPQKIVVEHARTGLMGPSQRADVLKEIARNRNANERIRQELREGGIEAPNRADIRRNSIIQDQESQCLYCGKEIGVLTAELDHIVPRAGGGSSKRENLAAVCRACNASKGSRPFAVWAGPARLERTIQRLRELQAFKTKSKKRTLNAIIRRLKQREEDEPIDERSLASTSYAATSIRERLEQHFNDDLPDGFAPVSVDVYGGSLTRESRRAGGIDKSIMLRGQRDKNRFDVRHHAIDAAVMTLLNPSVAVTLEQRRMLKQENDYSSPRGQHDNGWRDFIGRGEASQSKFLHWKKTAVVLADLISEAVEQDTIPVVNPLRLRPQNGSVHKDTVEAVLERTVGDSWTDKQVSRIVDPNTYIAFLSLLGKKKELEADHQRLVSVSAGVKLLADERVQIFPEEAASILTPRGVVKIGDSIHHARLYGWKNQRGDIQVGMLRVFGAEFPWFMRESGVKDILRVPIPQGSQSYRDLAATTRKFIENGQATEFGWITQNDEIEISAEEYLATDKGDILSDFLTVLPENRWKVVGIGDNRRFKIRPLLLSNEIIPDTLNGRSIKSEERDLIVSVLDKGVRVVASTLLTLPSTKIIRRNNLGIPRWRGNSHLPTSLDIQRAATQALEGRD

SEQ ID NO: 11766 - protein, 1087 aa, synthetic construct; identical to SEQ ID NO: 7600
  source 1..1087: note = MG15-166 effector

SEQ ID NO: 11767 - protein, 1087 aa, synthetic construct; identical to SEQ ID NO: 7619
  source 1..1087: note = MG15-191 effector

SEQ ID NO: 11768 - protein, 1078 aa, synthetic construct; identical to SEQ ID NO: 7620
  source 1..1078: note = MG15-193 effector

SEQ ID NO: 11769 - protein, 1097 aa, synthetic construct; identical to SEQ ID NO: 7622
  source 1..1097: note = MG15-195 effector

SEQ ID NO: 11770 - protein, 1106 aa, synthetic construct; identical to SEQ ID NO: 11616
  source 1..1106: note = MG15-217 effector

SEQ ID NO: 11771 - protein, 1120 aa, synthetic construct; identical to SEQ ID NO: 11612
  source 1..1120: note = MG15-218 effector

SEQ ID NO: 11772 - protein, 1121 aa, synthetic construct
  source 1..1121: note = MG15-219 effector
MNYILGLDIGIASVGWAAVALDANDEPCKILDLNARIFEAAEQPKTGASLAAPRREARGSRRRTRRRRHRMERLRHLFAREELISAENIAALFEAPADVYRLRAEGLSRRLDEGEWARVLYHIAKRRGFKSNRKGAASDADEGKVLEAVKENEALLKNYKTVGEMMFRDEKFQTAKRNKGGSYTFCVSRGMLAEEIGELFAAQREQGNPHASETFETAYSKIFADQRSFDDGPDANSRSPYAGNQIEKMIGTCSLETDPPEKRAAKASYSFMRFSLLQKINHLRLKDAKGEERPLTDEERAAVEALAWKSPSLTYGAIRKALPLPDELRFTDLYYRWDKKPEEIEKKKLPFAAPYHEIRKALDKREKGRIQSLTPDALDAVGYAFTVFKNDAKIEAALSAAGIDGEDAVALMAAGLTFRGFGHISVKACRKLIPHLEKGMTYDKACKEAGYDLQKTGGEKTKLLSGNLDEIREIPNPVVRRAIAQTVKVVNAVIRRYGSPVAVNVELAREMGRTFQERRDMMKSMEDNNAENEKRKEELKGYGVVHPSGLDIVKLKLYKEQGGVCAYSLAAMPIEKVLKDHDYAEVDHILPYSRSFDDSYANKVLVLSKENRDKGNRTPMEYMANMPGRRHDFITWVKSAVRNPRKRDNLLLEKFGEDKEAAWKERHLTDTKYIGSFIANLLRDHLEFAPWLNGKKKQHVLAVNGAVTDYTRKRLGIRKIREDGDLHHAVDAAVIATVTQGNIQKLTDYSKQIERAFVKNRDGRYVNPDTGEVLKKDEWIVQRSRHFPEPWPGFRHELEARVSDHPKEMIESLRLPTYTPEEIDGLKPPFVSRMPTRKVRGAAHLETVVSPRLKDEGMIVKKVSLDALKLTKDKDAIENYYAPESDHLLYEALLHRLQAFGGDGEKAFAESFHKPKADGTPGPVVKKVKIAEKSTLSVPVHHGRGLAANGGMVRVDVFFIPEGKDRGYYLVPVYTSDVVRGELPMRAVVQGKSYAEWKLMREEDFIFSLYPNDLVYIEHEKGVKVKIQKKLREISTLPREKTMTSGLFYYRTMGIAVASIHIYAPDGVYVQESLGVKTLKEFKKWTIDILGGEPHPVQKEKRQDFASVKRDPHAAKSTSSG

SEQ ID NO: 11773 - DNA, 22 bp, synthetic construct
  source 1..22: mol_type = other DNA; note = Spacer Sequence
aattagccgggggagcattttc

SEQ ID NO: 11774 - DNA, 22 bp, synthetic construct
  source 1..22: mol_type = other DNA; note = Spacer Sequence
cccagacctgtaatagtcatat

SEQ ID NO: 11775 - DNA, 22 bp, synthetic construct
  source 1..22: mol_type = other DNA; note = Spacer Sequence
ccaaagtctatatatgactatt

SEQ ID NO: 11776 - DNA, 22 bp, synthetic construct
  source 1..22: mol_type = other DNA; note = Spacer Sequence
caaagtttcttcatcatttgcc

SEQ ID NO: 11777 - DNA, 22 bp, synthetic construct
  source 1..22: mol_type = other DNA; note = Spacer Sequence
gatgctccggaatgttgctgaa

SEQ ID NO: 11778 - DNA, 22 bp, synthetic construct
  source 1..22: mol_type = other DNA; note = Spacer Sequence
ctctgtcctaaaacagaagtcg

SEQ ID NO: 11779 - DNA, 22 bp, synthetic construct
  source 1..22: mol_type = other DNA; note = Spacer Sequence
tgtcgacttctgttttaggaca

SEQ ID NO: 11780 - DNA, 22 bp, synthetic construct
  source 1..22: mol_type = other DNA; note = Spacer Sequence
gggtcagcatgccaatatgtgt

SEQ ID NO: 11781 - DNA, 22 bp, synthetic construct
  source 1..22: mol_type = other DNA; note = Spacer Sequence
tcatgcccgttcccagggactg

SEQ ID NO: 11782 - DNA, 22 bp, synthetic construct
  source 1..22: mol_type = other DNA; note = Spacer Sequence
actcaacatcatgcccgttccc

SEQ ID NO: 11783 - DNA, 22 bp, synthetic construct
  source 1..22: mol_type = other DNA; note = Spacer Sequence
gaacgggcatgatgttgagttc

SEQ ID NO: 11784 - DNA, 22 bp, synthetic construct
  source 1..22: mol_type = other DNA; note = Spacer Sequence
agttgcagccaacgaagtgcct

SEQ ID NO: 11785 - DNA, 22 bp, synthetic construct
  source 1..22: mol_type = other DNA; note = Spacer Sequence
ttggctgcaactgtatatctac

SEQ ID NO: 11786 - DNA, 22 bp, synthetic construct
  source 1..22: mol_type = other DNA; note = Spacer Sequence
gctagtgcggcaggcagagaag

SEQ ID NO: 11787 - DNA, 22 bp, synthetic construct
  source 1..22: mol_type = other DNA; note = Spacer Sequence
ggcaggcagagaagatgggcta

SEQ ID NO: 11788 - DNA, 22 bp, synthetic construct
  source 1..22: mol_type = other DNA; note = Spacer Sequence
aaccgtctggatgatgtgcgta

SEQ ID NO: 11789 - DNA, 22 bp, synthetic construct
  source 1..22: mol_type = other DNA; note = Spacer Sequence
gaggaaaattttggagacgaca

SEQ ID NO: 11790 - DNA, 22 bp, synthetic construct
  source 1..22: mol_type = other DNA; note = Spacer Sequence
tgctgcatatgtggctaaagca

SEQ ID NO: 11791 - DNA, 22 bp, synthetic construct
  source 1..22: mol_type = other DNA; note = Spacer Sequence
ttgatatcttcccagctgatag

SEQ ID NO: 11792 - DNA, 22 bp, synthetic construct
  source 1..22: mol_type = other DNA; note = Spacer Sequence
tgggaagatatcaaatggctga

SEQ ID NO: 11793 - DNA, 22 bp, synthetic construct
  source 1..22: mol_type = other DNA; note = Spacer Sequence
aattgttgcaaagggcattttg

SEQ ID NO: 11794 - protein, 156 aa, synthetic construct
  source 1..156: note = MG3-42 effectors PI domain
HGDVLTATIPASTFSFRNTPATLRKKLLAGEAVSVGWLTQNDEIEIEVDEFACGNTSFAKFLTEIPEKRWRVDGFYDNRRLRIRPAYLSAEGLTDNHSKVVHETLEKGQFVNAGALLSASRTLLIRRTALGAPRWKLDSSGLPVSFSPLKLAEEAL

SEQ ID NO: 11795 - RNA, 118 nt, synthetic construct
  source 1..118: mol_type = other RNA; note = MG3-42 effector sgRNA
nnnnnnnnnnnnnnnnnnnnnngttgggaatcgtcactgaaaagtgacgattctcaacaaaagacttttgtcttgatttctttatcccccggcattttgtgccgggggattcgttatt

SEQ ID NO: 11796 - RNA, 90 nt, synthetic construct
  source 1..90: mol_type = other RNA; note = MG3-42 effector tracr
gcatcgtttgaagaagtgacgattctcaacaaaagacttttgtcttgatttctttatcccccggcattttgtgccgggggattcgttatt

SEQ ID NO: 11797 - protein, 1165 aa, synthetic construct; identical to SEQ ID NO: 1094
  source 1..1165: note = MG16-3 effector

SEQ ID NO: 11798 - protein, 1117 aa, synthetic construct; identical to SEQ ID NO: 11723
  source 1..1117: note = MG86-1 effector

SEQ ID NO: 11799 - RNA, 107 nt, synthetic construct
  source 1..107: mol_type = other RNA; note = MG86-1 effector sgRNA
nnnnnnnnnnnnnnnnnnnnnnnngttttaatacccgaaagggtattaaactaaggtcactttttagtggctgactttagagtatggctttggctatactccatttt

SEQ ID NO: 11800 - protein, 1082 aa, synthetic construct; identical to SEQ ID NO: 9066
  source 1..1082: note = MG94-1 effector

SEQ ID NO: 11801 - protein, 139 aa, synthetic construct
  source 1..139: note = MG94-1 effector PI domain
KTVKNQVLVGDGVAERGGIYRCDVFKRKDEYYAVVVYYRDLYIGNLPNNAAHFDIEMKKGEFEFSLYKDDLIRFVKDGKEQYAYYKYINANNSQITYTEHDTSKETKCTTIRTLDKFQKMNVDLLGNIYSSDKEEREWN

SEQ ID NO: 11802 - DNA, 22 bp, synthetic construct
  source 1..22: mol_type = other DNA; note = Spacer Sequence
catgctgttcataatcactgat

SEQ ID NO: 11803 - DNA, 22 bp, synthetic construct
  source 1..22: mol_type = other DNA; note = Spacer Sequence
cagaagtcagtgtatgactatt

SEQ ID NO: 11804 - DNA, 22 bp, synthetic construct
  source 1..22: mol_type = other DNA; note = Spacer Sequence
taacgtctcctgatcatttgcc

SEQ ID NO: 11805 - DNA, 22 bp, synthetic construct
  source 1..22: mol_type = other DNA
ctctgtcctaaaacagaagttg

SEQ ID NO: 11806 - DNA, 22 bp, synthetic construct
  source 1..22: mol_type = other DNA; note = Spacer Sequence
gagtcagcatgccaatatgtgt

SEQ ID NO: 11807 - DNA, 22 bp, synthetic construct
  source 1..22: mol_type = other DNA; note = Spacer Sequence
ttctccatttcattacagcctg

SEQ ID NO: 11808 - DNA, 22 bp, synthetic construct
  source 1..22: mol_type = other DNA; note = Spacer Sequence
tcatgccagttcccatggtctg

SEQ ID NO: 11809 - DNA, 22 bp, synthetic construct
  source 1..22: mol_type = other DNA; note = Spacer Sequence
gaactggcatgatgctgagttc

SEQ ID NO: 11810 - DNA, 22 bp, synthetic construct
  source 1..22: mol_type = other DNA; note = Spacer Sequence
agttgcatccagcgaagtgcct

SEQ ID NO: 11811 - DNA, 22 bp, synthetic construct
  source 1..22: mol_type = other DNA; note = Spacer Sequence
ctggatgcaactgtacatctac

SEQ ID NO: 11812 - DNA, 22 bp, synthetic construct
  source 1..22: mol_type = other DNA; note = Spacer Sequence
aactgtacatctacaaagaccg

SEQ ID NO: 11813 - DNA, 22 bp, synthetic construct
  source 1..22: mol_type = other DNA; note = Spacer Sequence
gatagtgaagcgagctgagaag

SEQ ID NO: 11814 - DNA, 22 bp, synthetic construct
  source 1..22: mol_type = other DNA; note = Spacer Sequence
agcgagctgagaagcagggtta

SEQ ID NO: 11815 - DNA, 22 bp, synthetic construct
  source 1..22: mol_type = other DNA; note = Spacer Sequence
aaccgcattgatgacgtgcgga

SEQ ID NO: 11816 - DNA, 22 bp, synthetic construct
  source 1..22: mol_type = other DNA; note = Spacer Sequence
aggttcaagctgccaccacaac

SEQ ID NO: 11817 - DNA, 22 bp, synthetic construct
  source 1..22: mol_type = other DNA; note = Spacer Sequence
aagggaaattttggagacaaca

SEQ ID NO: 11818 - DNA, 22 bp, synthetic construct
  source 1..22: mol_type = other DNA; note = Spacer Sequence
tgctgaatatgtggcacaagct

SEQ ID NO: 11819 - DNA, 22 bp, synthetic construct
  source 1..22: mol_type = other DNA; note = Spacer Sequence
gtaatatcatcccagctgagag

SEQ ID NO: 11820 - DNA, 22 bp, synthetic construct
  source 1..22: mol_type = other DNA; note = Spacer Sequence
tattgttgtaaagggcattttg

SEQ ID NO: 11821 - DNA, 20 bp, synthetic construct
  source 1..20: mol_type = other DNA; note = PCR_mHE1_F_+233
gtgaccaaccctacccgttt

SEQ ID NO: 11822 - DNA, 20 bp, synthetic construct
  source 1..20: mol_type = other DNA; note = PCR_mHE1_R_-553
gcaagcacctactgtctcgt

SEQ ID NO: 11823 - DNA, 24 bp, synthetic construct
  source 1..24: mol_type = other DNA; note = Seq_mHE1_F_+139
gtctaggcatacaatgtttgctca

SEQ ID NO: 11824 - DNA, 20 bp, synthetic construct
  source 1..20: mol_type = other DNA; note = HAO1_E2_F5721
caacgaaggttccctccagg

SEQ ID NO: 11825 - DNA, 20 bp, synthetic construct
  source 1..20: mol_type = other DNA; note = HAO1_E2_R6271
ggaagggtgttcgagaagga

SEQ ID NO: 11826 - DNA, 23 bp, synthetic construct
  source 1..23: mol_type = other DNA; note = 5938F Seq_HAO1_E2
ctatgcaaggaaaagatttggcc

SEQ ID NO: 11827 - DNA, 20 bp, synthetic construct
  source 1..20: mol_type = other DNA; note = HAO1_E3_F23198
tgccctagacaagctgacac

SEQ ID NO: 11828 - DNA, 20 bp, synthetic construct
  source 1..20: mol_type = other DNA; note = HAO1_E3_R23879
cagattctggaagtggccca

SEQ ID NO: 11829 - DNA, 21 bp, synthetic construct
  source 1..21: mol_type = other DNA; note = PCR_mHE4_F_+300
ggctggctgaaaatagcatcc

SEQ ID NO: 11830 - DNA, 20 bp, synthetic construct
  source 1..20: mol_type = other DNA; note = HAO1_E4_R31650
aggtttggttcccctcacct

SEQ ID NO: 11831 - DNA, 22 bp, synthetic construct
  source 1..22: mol_type = other DNA; note = PCR_mHE4_R_-149
tctgccatgaaggcatatggac
